United States Patent 12,642,819 (COMPOSITIONS AND METHODS FOR TREATING INFLAMMATORY BOWEL DISEASE) - sequence listing, part 9

SEQ ID NO: 5 - DNA, 5105460 bp, Bacteroides fragilis (residues 1-1,701,820 of 5,105,460)
  modified_base (640398)..(640495): a, c, t, g, unknown or other
  modified_base (1119157)..(1119254): a, c, t, g, unknown or other
  modified_base (1253139)..(1253236): a, c, t, g, unknown or other
  modified_base (1831405)..(1831504): a, c, t, g, unknown or other
  modified_base (1935262)..(1935361): a, c, t, g, unknown or other
  modified_base (2188536)..(2188633): a, c, t, g, unknown or other
  modified_base (5087903)..(5088750): a, c, t, g, unknown or other
ttaaatgaaaaatcttatatttatactgggttgctttctctttctaatctcatgtcagcagaccgagaaggaaaaacttgaagaacttgttaaaaactggaatgggaaggaagtacaatttccgacaaatcttagttttacgttatatggaaaaactcctgtcgattttaaaatccctgcttcggattataagatcgtgacctatgtcgattcgttgggttgttccagttgtaaattgcaattgcctaaatggaaggattttatgaaatatgcggattctatagtaggctatcaaataccggttcttttttttcttcatcctgctaatgttcgcgagatgaggtctgtgttaaaacaaaatcgttttgattatcctgtttgtatggatacggaagatacttttaataaagtgaataagtttccttcacagctaaattttcaaacttttttattagatagaaacaatcatgtaattgcgataggaaatccggtccataattacgatgtaagagaactctatatccatcttatttcaggaggaatagatggagattctctttcaaatatgcgaactgtgataaaaatagagaaagatatggttgatttggggagttttgattggaggcgagagcagcatataacttttgagatacacaatattggtgataataatttagtcgtttatgataataagacatcttgcggatgtacttctgttgaatactcgaaagaacctgttcagcccggaaagtctttagcagttaaagtaacttataaagcggaccatccggaacactttaataaaactattatactatattgcaatgcttccgcttctcctttggagttaaagataactggaaatgctgaataatttaatgtttatatttagtacttttgaatctttattgacaggtatttgtatatgtccccttagcttgaatatatgttgctaaatataggtagtcaaccttggatcattgcattggaacctattaatgttatggttcaaggttgatttttatttaatatttgttatatgagaaatctgtttttaatattccttttttgctatgtaactgggaaagcccaggacggagcgtgtgtcgtgagtgaaaaggatagcattcctctttcaaatgtatatatctgtttgaaagataggagagtcatagctatcagtgatgaaaagggtgtgttctcattagagaaatatgattcgttgtcattgaatgatactttatatttttctcatattaattatttgcacaagaaattgtcttatggtgatttaattaaaaatagatgtaccgtttttttgatagagaataatcgggttttggaagaagtatctatttttagcaataggcatttaaatcgctttttgcattatgaaatattgtctccattgaaaagaggagtctattcgtttgcttcggtcttggtagatgggcagatttatattgtaggagggagtacgtcgtgcggtccctttcagagtaatatacgttctactctattttgggagaaatatagtaacatgatgtatagatatgatatcaagcaagataagtgggagacgatcaggcataagtttagagaaagggcatatcatacggcgggttattatgatggaaaaatttttattttagggggaaagagattgtctgaaaccagaattgttgattatctggataatgcaatagaaatatatgatattaagcgtgataccgtttggacagattatactaatccgcatcaagcgactctattgggatccgttgtgtataaagataatatgattgttttaggcggtgttaaaaaggttttgcaaaataatgaaggagtctattcggatgaaatgcatttatggaatttaaaatccggctactggtatgagttgggaaaaatgccgattaggcaagctcctgatgcaattctggttgatcattgtatttatttaatcggaaatagtaacggtggcggctggagtattgaatgttataacttattgacaggcgcatggaccaatgccggacatttgttatatcggcttggctggcccagtttagcttatcataatgatataatttatatttttgaacaaggtgttgtgcagacgttcaatataaaaagcaggcaagttcgttcgtatatgatagatctgaaattgaaatctccagctttgtattactttgatgggaaattatatattttgggaggattttatatgggagatccctcgcgcaatgtatatagtattgatctgaaagaatttgataaaacagaaatcgattattattataacaataaaaggtaagcattcggtgaatcctgtctattgtatagaaactgaactttattgttttttcttattctaccattattatcatatttttaaaatctaaaagtatctctttgcaatttttgaaatagttaactcctaaatagccattgtatttgccattagcattcttcatgatcagtatattgagcatatgatgaaaaacatagactcagaattactaaaatcaagcttgttcttttcataatattatggtgttgtttacaaatatggtaagtcttatagatgatagcaaatattcttttccaaaatttgttaatcttgtttggggtgcttgaagtattttaaattaatatggtagaatatttatttggttttctttttatcaagaaatatcgttctacacttggttccatattttgaccccgttttacaagtacatatccacgtagtttctctaacaacaagtcaagagggagcatacgtcattgacaaccggtcttcactaaataaaagattgcattccaaatcattcgtaaatcatattttcgctttcttgcttgcgggttcaacacttttgttatatattgccactctgtttccgttaaatcagtttgatacatctttttttaagtttggtcacttcaaagaaagcaactatcagactgatatggaaactttgttaggaattttctttactgcctctaaacaaactgcaaaatgcagtagtattggaaggtctggaaatgaaggtgattttcgggggaagcgggtcttcgttgtgcccagatggttatccgtatgtattcaggtgttctaatggcaatctacattgttgcaaagttaattcagagtctgtttgttgtccataatagacaacttactctttattaaatgcttatcatctattttggcggatgataaggctctgttaattaattaaaattgaagatcatgaatatgagaaaagtattttatttagtcttatcacttgtaattgcaagttgcacctctaataaggaactgcaagagaaactggcatttattgatgtcaccaaagaatatcccgaaaagaaaattgagctcaccgatattgcggatgtctcttatctgtacctcaattcgaaaaatgatgattatctctataaaggcagcattgattatgtaaccgaaaacaatattattgttatagaccgctctcagaacagcgtgctgtttttctcaaaagagggaaatcccaaatcacattttaaccgtaggggacagggatcggaagaatacagagatgcatattcggtaatgtatgacgaagcaaatgatgaagtgtttgtttcgcccgactttagcgatcatattatggtctattcatcattgggtgaattcaaaaggaaaataaatttacctcagacgaatgttaacggacaaatggccttgtttgacgatgtgtccatattggtgtatgataacacgaaattgtggaaatctatcatgcaaagcaatgccccagatatagtacaaaccattgattcagctttctttcttatttctaaattggatggtacagtgctggattatatctcactaccaaacaaaaatatagatctgagttataaagatttgaacagtgtatttactggtcaggtgagttacggacgtgtgagaaagtcggctgacggattacttttatacaatcctgaatccgacaccgtttttcattacagcaaagaaaagcgtttaactccatatatgcacaaaaaaccaatattgagcagtcaaacctcaatgacggttatggatatctgcatggatgcgggaaaatatcagtttatagcagtttacccttatcgggaaacagcgaaatctccgacaccaaaatattatatgcgcaacaaagcaacaggagaactgtttcgccccaaaataactctttccgattttgaaggaaaagagttgtatatcaatccccggcttttaaattattatgaacatgcataccactttgaactagattttgctgaactcgaagaagcatattacaaaaacaagctcagcggtaaactcaaagaacaggttgcttcacttcttgaagatgaggaaagtaataatgtttttgtgtttgcggatttttattgataaaaacacaccttctggggttgttttcaatattgagtgatttgtaaaaagagttacagataagcctggactacatgaagagatgatattacatgtcgtaccaagatcaatacaatattttagtaattgccaacaagtcttcaaactacaaaacaatgacttttctcgtagcgcactcagagataatactcattattaaatatttaatagagggggaagtttacaaaagtcccgcccactcctgattggttagtgtggggagctgatctgtttctgtgatgaaagtttccgccagttttcgtttttcctcttgtagctgtatgattttctcttctatgcttccttgcgtgatgaaacggtaagcaattacttgtttgtcttgtccgatacggtgcgcgcgggcaatggcctgtgcttcggctgccgggttccaccagggatcgatgatgaacacatagtctgcttgtgtcaggttgaggcccactcctccggcttttagtgagataaggaaagcttgtatcctggggtcacggctaaagcgtgcaatctcttccgggcgattggtagaagagcctgttagaagagcataatcccattgacgtttacgaaactcatcggccaccaattccagatgtttaacgaaagaagaaaagatcaggaccttatggccttcgctccggagtgtttcgaaggtctctataatcaggtttagtttaccggattcaccgatgaaaccgggtaaaatcatctgcggatggcaggcgagttgccttaaacggagaatcccgttgagtactatgagcggttgctgacccttctctacggtctgttccagcagaatgttccgaagactgttcttttcatgttggtagagctcgttctgtttctttgccatgtcgcaataaatcacttcttcggttaatgacggtagttccggagctacttcctgcttgcttctgcgtagtataaatggggaaatgagttgtcgtagacgaaacttcatccgttcgtcaccttgacggatggcgttgacgaactgtttgctgaacgttgtctcgtttcctaaaagttcaggctgtagaaaatgaaactgtgcccaaagatccttcagggaattctcaataggagttcctgtcagaattagcctgtgtttactttgtaattgtatcgctgaacggaatgtaagtgattcgctgttttttatgttttgactttcatcgagaactatgtactcaaacttatattgggataaagtcgcaatattattgcgcatcgtgccataagtggtaaagaccagatgatattggtcgaagtgctttgacaaacgattgatttcattggcggagtttccgttatattccgtcattgacaggctggtaaaacgggatgcttcccgtttccagttatgcaaaagcgaggtaggcacaacaataagggtggcatgcaggcgtggtgtctggcttttcttttgatttagtacagcacattgcaagtcgttttgtccgcttcggaaggcgttgggggcttcggtttttaccggaaaaagtgataactgccccttttcatcgaagaaagcttccttttgcacaggagagccttgagtgttttctttctcttccaggctgtttgtttcctgatttgttgaggcggctgttcccggtttgtagatgtattgtaaaagtgtaagagtttgcaaggtctttccaaggcccatatcatcggccagacatcctccgaatttttcgaggtataggtttgccatccatgagaaacctttctgctgataggagcgaagattggccttgagccctgcaggtacagggattggtttctccaatcggacgccggttgctatacctggacctttttccaggatcgattttattacacccacaaaaggacgcttcagtcggatgttcttacctgattctttacctatctcaagcagattggcgtatttggtgaaccattcttcggggaggaggataatgcgtccgtcagagaggggatattccctgttgttgtccagtatatttttgcggaatcggctaaagggaattttctgattgtctatgacgacattgatatgtaattcgaaccagtcggggccatcttcgtaatcctgttctatccggatatccggaagatagtatggcttcttgtgcgtatcacttgataagataaacttttccagtagcatttcccggtgacggctgacccactcggtaatgtttttttcgggagcgataggcgatagtttgaaatgggaatcactgacacattgtaatccggctttttgaagcagacggattgcctgcttctcggcagttgagttacgttggaaatagtggatgacagtttgtccattctcttgctcccggaagatgattttcttgattccatcggaaccatgaggtgaaaaagtccggtctccataacgaaaatcaagccgtaacaaagtatcattatagattgtatcttcaaggtagagataagcatcacacggacgtctttctctgatcattttgactccttgaatattgatttcatggtaatatgcaaggggaatcatgatattgtctatgtatttttcagtcaatgaagcgtccacgctgatacgttctttcttggtgaaaggcagtaagcgtgaagcttcaatatgggggacagtaaataaatccatacccagcaataaggtggcaggattggaggtgaggacagtgacaggtttttgttccatcagtgaaaccggcaggtcgtcatagtagcattgcagttgatagctgaaatattcctcggttactttaaaagagaaatgggcttctaaatcgtggggatggacacggtatgcatggtgttcatagagttgcttgcttccacttggtttctgataaaacggaagttgcctggtgcgtatcagttctaacatctccaacagtttcttctctatgaaaggacggatttgttctttaagtttgttattgtcctcggccagtttgcggaggaatttagggactgttttttcacgggaatagactcccatcagatatttttcagtataatgagaagcaatgtcaatggctttttgttctgcttcattcatttttttgatcgcatcgggagaggaatggaaagcttgttcgatcacttccaacgtgttgtcaggggttcggctgacagtgtaggggatgagtaatatccccagaacagggtgctctacgagtacaatgacaacttggttggtggaaagtgcttttttcattctgtccggtttggaaggtcaaagatacgggattttatgtaattttgcggtatgatggaggaaaacaaacgagtcttattgggaatgagcggtggtacggatagctctgtggctgccatgctattacttgaagccggttatgaagtaacgggagttacctttcgtttctatgagtttaatgattctacggaatacttggaagatgcccgtgcattagcaactcgcttaggtatcgaacatatcacttatgatgcgcgcgagattttccggaagaaaattgttgattactttatcgatgaatatatggccggacatactccggtcccctgtactctttgcaacaactggttaaaatggcctttgttggccaagattgccgatgaaatgggtattttctatttagctaccggtcattatgtgagaaagaaatggatggatggaagctattatattacgcttgccgcagatccggataaagaccagtcattttttctgtggggattaaaacaggatattttgcaacgtatgttgcttccgatgggtgagatgactaaacctgaagcacgtgcttatgctgccggaagaggttttgagaaagtttcaaaaaagaaagatagcatcggggtttgtttctgtccacttgattatcgtagttttctgaaaaagcatctttgcgatgcgggaggcgacaggagcaataaaataatccgggaagtgggcaaaggcagattcctcgatgaaagcggcaattttattgcctggcatgagggatatcctttttataccatagggcaacgcagggggttaggcatccaactgaaccgtgctgtttttgtaaaggagatccatcctgaaaccaatgaagtgatattggctcctttaaagtcccttgaaaagtcagagatgtggttgaaagactggaatataatcaacgaatcccgcctgctgggctatgatgatattattgtgagaatacgttataggaaacaggaaaaccattgttctgtcacaatcactccggagggattattacatatacaattacacgaacctttgtccgccattgcagaaggacaagcagccgctttctataaggatggtttgttgttgggaggagggattataacgatgaatgatgaacgatgaatcgtatgcggatagcacacagcccattcatcgttcatcgtttatcgttcattgtttattcaaagcaatcatttcttcaatgtagtctcttgtattgctgagtctcggtactttatgctgaccacctaatttccctttttgagctaaccagtcatggaaaagtcctttgcgtgcgacaatcacttccaatggttggagagcgatatctttccatcgttttgcttcgtagtcggagtttacttctttcagtgtagtatccagtaccgccgcaaatctttcgatggaatcgggcattttggcaaactcaataagccattgatgacggcatttggcattttcatccataaatacgggggcagcggaatattcgctgacttgagcaccagtttcagcacatgctttggcaagccctttttctgcattatctacgatcagctcttcaccaaaagcattgatgaagtgcttggtacgtcctgtaatgacgaacttatacggattctttctggtgaatttcacagtatccccgatcatgtaccgccataatccgcaggaagtggagatcaccatagcataatttttatttagctctacttcttcaaggcaataggtgcggggattctctttttccacatcctccaaaggaataaattcgtagaaaataccatagtcaatcatcaataacatagatgggtcggagaaatcgttttgtgtcccgaaatagccttccgatgcattgtaggtttcgacataatgcattttagaagaatgaatgacttgcttatattgttcacggtaaggggtaaaagcgacgcctccatggaagaatacttccagattgggccatacttcttccaaggtctgcttgcctgttttttcaagaatacgtttgattaagaccagcatccaggaaggaacacccgaaagattggttacatctaccggtatggtgctgttggcgatagcttcaattttggtttcccattcgtccattaatgctatttgcttgcttggcacacgtatcaggttgatcagcggacttacattctggatcaatatggctgaaaggtcacctaccagactatggttggagttcaggttcggactatggctgcctcccagaatcagtcctttaccggaaaaaaaacggctgtcgggattcatgcggaagtagattgcggccgcgtcttttcctccccggtaatgaatatcctgcaaggcctctttgctaaccggaagaaacttgcttttatcgtttgtggtgcccgaggattttgcaaaccagcgtatttctgaaggccacaataggttttgttcgcctgcacggagacgttccacatagggctttacttcttcgtaggtttgtatggggagtcggtttttaaagtcttcgtaattgcggatagatttataatcatacttctttccccattcagtattttctgcctgttttacgagacgggtcaatacccggtgctgtatatctccggcttgtgtatcataaagatctatggcttttaaacgggaatcaaatactttgcttataatctttgtaatattcattgctctttaacatataatgtttagtcgtgcaaaaatagccttaattatcttttttttctatctttacgacggaaataatagttaaaagtgaagatatgtcatgcttttgcagacagatgagtaacttttttcttttaaatacgtaatattcaataaaaaaagagcagcaatgaagatcggaattcttacatccggaggagattgccccggcataaacgctacgattcgcggggtgtgtaaaacggccattaatcattatggaatggaagttgtggggattcacagtggttttcagggattgctgacgaaagaggtagaatcgtttactgaaaaatccttgtccggattgctaaacctgggtggtactatgttgggaacttcacgcgagaagccgttccgtaagcaaggtattatttcggatgtggataaaccggcgctgatacaacgtaatattgctgaattgggacttgattgcgtggtgtgtatcggtggaaatggtacgcaaaagactgccgcaaaatttgcagcgatgggaattaatatcgtttctgttcctaagacgatcgataatgatatctggggtacggatatctctttcggattcgattcggcagtgagcattgctacagatgctatcgaccggcttcactctacggcaagctctcacaagcgggtgatggtaatcgaagtgatggggcataaagcaggatggattgctctatactcgggtatggcaggaggaggagatgtaatcctggttccggagataccttataatataaaaaatataggggatactattttaaatcgtttaaaaaaggggaaaccttattcgattgtggtcgttgccgaaggtatccaaactgatgggcgtaagcgtgctgccgaatacatcgcccaggaaattgaatatgagacaggtattgagacgcgtgaaacggtgcttggctatattcagcgcggtggctcacctacacctttcgaccgtaacttatctacccgaatgggagggcatgcaacggagctgattgctaatgggcagtttggacgtatgattgcattgaaaggtgatgaaatatcttccgttgcattagaagaagtggccggaaagttgaaattagtgactgaagaacatgaccttgttgtacaagggcgcaggatgggaatatgcttcggataataatcggaggtgtttagattatatactgatattttcagttgatgttattttatcaacttgcggagattcctctgtctggtttatttcaggatcgtcgggtgtatcttctgtggagatattattctgtactttggcttcttgtacacctgccatgaactcaggatcccctttgatttttttgagggccatctgtgcggcattctgttgtgattcctttttggagtatcctgtaccggctcctccgagtatgccttcaatccggacttctgtctgaaacacgggattattctctttgtcaaggaactgttctattaattcgaaagaaacttccatcttgtttttctggctccattcaatcagcttagacttgaagttcacctctttgcgtgagagtttgtccagatctatatagggctcgatgattttcttctgcataaactgtttgcaacattcatatccccggtcaagataaatggctccaataaaagcttcgaacgcattcccatacatatagctgttgtgggaagaagaacgtgtagaatatttgataagtttgtccaggcctatttcgactgccagtttatttaatgtttcacgctgaactattttagaacgggtgtttgtcaggaatccctctcttttaccttcgaaatgttgatagacaatatcccctacgatggcgtcaagaatggcgtcaccaaggaattccaggcgttcgttgttcaacggacgtcctttctccgaacgtacagctgtcgatttatgcaggagagcctgctcgtatagccggatgttgcgtggatagaatccaagtatgcgataaaaacaaaaataagactctctatccttacagaacaggagccttatcttatctattttattacgtaacacgactttattcagcgtatttcttgaagattacacaagcattgtgaccaccaaatccgaatgtattcgaaagggcaacgttaacttcacgtttctgtgctttgttgaacgtgaaattaaggttatagtcgatgttctcgtcgttatcaccttcggcatgattgatagtcggaggaacgatgccgttcttgatggcaaggatacttgcaatagactctaccgcaccggcagcacccaacaagtgacctgtcattgatttggttgaactgatattcaactcaaaagcatgttcgccaaatacttccttgattgctttggcttccgatatatcacccaccggagtggatgtaccgtgaacgttgatgtaatccacttctttaggatccatttctgcatcttccagggcattcatcatcaccagttttgcaccaagtccttccggatgagatgctgtcaggtggtgagcgtcagcagacatacctacaccggctacttctgcatatatttttgcgccacgggcttttgcatgttcaagttcttcaagaatcaggcatcctccaccttcacccattacaaaaccgtcgcggctcgcgctgaacggacgagatgctgattgtggttcgtcgttacgagttgacaatgcatgcatagcgttgaaacctcctacaccggctgctgcgatagcggcttccgaaccaccggatacaatcacgtttgccttacccagacggatcaggttgaatgcatcggcgatggcgttagtagaagttgcacatgcagaacaagttgcgtagttcgggccgtggaaaccatacataatagaaatctgtccggcagcaatatctgaaatcatcttagggatgaagaacggattatacttgggaccgttttctttgtgaagggcataattgcttgtttcctcctcaaatgtacgtataccaccgataccggcaccaaaaataacgccgattctgtttaaatcctcattttcgatatcaagacccgagtctgcaaccgcttctttggcaacggcaacggcatactgtgtgtacaagtccattttacgtgcctctttgcggtcgatatattgagttacatcgaagcctttcacttcacatgcaaattgagtcttgaattgcgatgcatcgaaatgagtaataggtcctgctccactaaccccgttcacgaggttttcccaaaattccgggacagtattgccaacaggagtaatggcgcccagacctgttactacaactctctttaattccatactgatgaaatcgaattacttagcgtgttcttcgatgtaagctacagcatcctgtactgtgccaatcttttcagcttggtcatcaggaatagagataccgaattctttttcgaattccatgataagttctacagtgtcaagagaatcagctcccaggtcgttagtgaagcttgctgtttctgtaacttctgattcttctacgcccaatttatcgacgataatcgctttcactcttgatgcaatttcagacataactttaagtttttaattaataattagttttatttctttaaatttgcggtgcaaaggaataaatatttatcgtcctgcgcaaatttttgattaaataaatgcaatcttttgcacatttttcactgttttgtgcactaaaaggtctgattatggagaaaaacatcgctatttttgcttccggctctggtacaaatgctgaaaacattatccggtatttcgagggaaatgattcagtcagggtaaaattagttctttctaacaggaaggacgcgcatgttttggagcgtgcacatcgtttaggagtgccctgtagggcttttccgaagtctgattgggaaatagcggaatccattttggatttgctgcgtgaacatcagattgacctgatagtgttagccggcttcttgttgcgtataccggatgcacttttgcatgcttatcctaataaaattataaatattcatccggctcttttacctaagtttgggggaaaggggatgtatggcgatcgggtgcatgaggcggtggtaatggcaggagagtccgaaagtggtattactatacattatatagacgagcattacgatgagggaagtatcatttttcaagctaaatgctcagtacttcccggagatacccctgcggaagtggctaaaaaagttcatgcgttggaatatgaatggtttcccaggatcatagaacaaaccgtaaataccttcttatagagctggttttctgaggaaatgttttatagtatcgtatgaggttgtgtcgaaactcttttcaccacagcctcatgcaatgtttaatatcctcttattgaggatcggcattatcagggttaaatagtaaatcaaccgatattaatcttatatgctccttcttctctccttaatgggtaatctccccggagttgttcaaatagcttcggatgggtctttagtgtatcgctgtcccgtcggggatcgtaaatttgcagggaggccgcttcataagttgttgcggaaattattttgttttccggttccggaggaacaatccgatagccggctccaatccggaagaaccggcataaggcttcaagtgacattcgggttgcgtttgcttttccgtctgcggaatatccggcgatgtgaggagtgcctataattactttctctaataatttaagattgatatccggttcatgttcccatacatcaatgacagcatcggacaaggtacctgactgaagagcatcgagcagtgcctctgtttcgataacttcaccgcgtgaggtgttcatgactatcgccccctttttcagtgaacggaagaagtgcttgtctgccaaatgataagttttatattttccctccttatataaaggtacatgaaatgtgattatgtcacactctttggctatattctctaaagtagtgaacattgtgctttcttctttttctgctctgggaagatcgttcagcattactcgcattcctaattttcgggctacatcagctactttgcttcctacatttcctacgcctacgatgccaatggtcatttgatgcaacttcattgcatgggtttgttgtaaaatgaacagggcagattggatatattgtgcaacggatgccgaattacatcccggggcattggtccatgtgatacctgcttcccggcaataggctgtgtcgatatgatcgaatcctattgtagcggttgcgataaattttactttgcttccggcaagcagtgaacggttacaatgcgtacgtgtgcggataattaatgcatcggcatcatgtatcagttccggggtgaaatcttttcccggagcatatactacttcatcggctatttgctcaatagcctctttgatgtaaggtattttgttgtctacaataactttcatgattgatcaggggtttgcatgcaaaggtaggaaataaaaagcaggaaagattggctatatggaaaatattgcatagatttgcccggtaatgcgcattacgataagtttgaacttagacaatttatatcaataatgaagtgtatccacattattactccggtaaaagattctattgagttgacgttgcaaacagctgaggctattttaaaatcagatttcaccgttccttttcattatactatttataatgatttcagcaccgatgaaaacacgaaacgactgaaagaagcatccctggcgatgggatttgagttaattaatctgtgcgagatcacttctcatccttctcccaattatttgctggtgcttcagatggcacaagaaaaggctgttgccgctgaagcaggcttgctgatcgttgaatctgatgtgattgtgaaaaaacacactttgcagtctctttttgatggtgcgcagtccagacaaaactgtggaatagctgctgctgtgacagtagatgagaacgaggtaattaattatccctatttatatgcgaaaggcaaagaaaatcaggtgtttccggaaaagaaacatcttagtttctgctgttctttgctgacaaccgactttctgcgtgcttttgattttcattctttgaatccggaaaagaactggtttgatgtaactatttcccatcaggcacttgaaaaaggttttgtcaattatctgtttactactttgactgtatggcatcgcccgcatagtagtcgtccatggaaacagttgaaatatacgaatccgcttaaatattactggttgaagttcactaaaggattggataaaatttgatggtatggcaaagccgttagtatctgtagttattcctgtatataatatggaggagtttctggaggagacactggattctgtcctgtcttctgattatccgaactttgaggtgattgtgatggatgatggttcgaaagaccgttctcttgaaattgccgaaagctataagtcccggtatgaaaatgtaagggtttacacacaagtaaatagtggcgttgctacggctcgtaatcatgctatttctaaagcaggtggagtatatattttgccggtcgatgctgataatcgtattagtaaagaattgattcattctgctgtagatatactggagtcggatccggaagtaaaagtggtctgtccacgtgccgagtttttcggagaccgttcgggcgaatgggtattaccacctttctcgctatcattgcttgctcgtaaaaatatgatggatacttgtgctgtttaccgtaagtccgaatgggaaagaattggaggatactgtgcggagatcgtggctcgtgaagattgggaattttggatctcaatgttaaaggatggaggaaaggttgtaaagttgccggaaataggtttgttttatcgggtgcgcgaacagtctaaacgtgttactgaccgtttgctaaaaaagcatgtgattgacgtcctaaatagacggcatcctgatttctttgagcgggaattgggagggccgttacgttatcagcgttcctggtcaaggttaatcaatcggatttcccgaataatccaccctcggagagtcttcgttggagatgattttcaggacttatcttcttttgtacgtgtattacctgtgcattttgagaatggaggaacgttgatatatgaaggaagaaataaattgaaagagtttgaaatacatggtagaaagttgatagtgaagtcatatcagcttcctcacctgattaatcgagttgtttataattcttttcgtgcctctaaagcccgccgttcttatcaatacgcacagatgctgcgtaaagcaggtattggctctcctgctcctgttggattttattctacgggaacatggttgttgtttggccgtagctactttgtgagcctaaagtccgaatgtccttatacgtatcgtaatctgttagaggagacttttaccggtgacaaagaaaaggtattacgtgctatagcacgtaccacagcagctttacacgaaaacggttttctacataaagattactcgggagggaacattctttttagggaaacggataaaggcattgaagtggaaatcattgatttaaaccgcatgcgttttggtaaagtcgacatagaaaccggttgtaagaactttgagcgcttgcccggaacacacgagatgtttgttatcttggcagatgaatatgccaaagtgaggggattcgatgccgatagatgtctggaactgattgagaagagtcatttatgacgcattgattgagacaaccctttgcctaagattatggtgggcagtatataccaacgtctgaagtggaaacataatttgattataatgatccatttatatatgatatagaataaaaaattggaatgctttttatatacatataattttgaaataaacctttctttgtaagccagcgcataaacttttgtagattcaccttggaggtgtaaaaatctataggttggcagaaccgttgactgatagttgtgataagataatcttgtacagatatcatactcttcataatagaggaatatattagtatcaaagcctttgattttgaagaagacttctgaaggaaacatcataaatgctccgttgatccatgaagcatgtataggaaactggtatactttcttttttcgtttggggtagcgggcgggacataatctttccgggatgtcgtttcctaaaatctcatatagaataccgattggatgattgaatgagggtactgccttcaggtgtttgttgtattgctgtggtgtaatgcatcctgtttgaggattttctttcaagtaactgcataatgggctaatgcagtcctctaatagctcagtgtcattgtttagaaaacagaggtatttcccttgggctatgtttgctccaaccatattccctgccccgaaaccactgtttattttgttgcgtataatagtaatttcctgaccggaaagattttcagtaaggtgttgatagtctgtttcctggctggcattgtcgacaactattatttcgtaagtgccattaggcaggtatttgtgtatactgttaatgcagtttagggttaatcgggaggtattataattcaggatgataattgatactttcatagtggtatggggtttatttaattattattggggttatatatctatcgaaatccagctttccggaagtatgtggggtgtcttcttgacgtttgaccagcgtgaaggtgcgataacagttttatccttataggcatttagccatgctccccaccaactgaaactgctgttggctattatattatgacggcacaggctcatcaacatcatgtcctgccaactgtcagggcccttattccaggatatatattgatggggtaaatgatgtatcttcaaatgtgctttcgtccattccacatcatcagaaaagatatggaagaatgctttcggttctttttttagtatgattgagattgccttttgatagtattcttctgtacatatatttccgtattttattttgtttttggctgatgtataatctcctcttcggatatgaattgatacgctcgaacgttgttctttaattatctttgcccattcttttgttctgaaattggcattttctgtgttgaaagaaaaaatatctcttatggtatctgaagattctttgaagaagagttcagattgaaagaatcctttgtaatatactaatggccatctcttgtgttgtgtgtatttatgaatggataattcttcttcggatttttctcgtataatcgaaaagaatgcatacacaattactcttttaagccatttgtgggcatatattgtttgggggcggatcgaaaatacatcttccaattcatatccgttatgtaatttatatttcttcatttcagacatgtctatccgaagctccggaaatattgttttcatttgtatatagaaggcgtaaatgaacatttgattccctaatccgcctgtcattcgtactaatttcatcattctttgattttgatatgtttttttaaacgtacgtttaaaaaacatcatattttaacctgccatttatttttatatgttgtgaaatatggattatattgtatgaggtgtaaaaggcttattaaaggtttgtttaatctttatctccggttttcttaataaaaaactgtaattagttttttcaagtagaaaataagtcttatttttgtttcattaaacgtacgtttaatgaaacaaaaatgaagctgaaagacgtttggcttaactgcttaatgatatgaatgatagtcttttatataaactttccagtggcaagcctcctaagtttatttattttataagtaatactttgaagatgcttattccgaatgctttttatcggtataagttgaaaagtacattggctcaattacagtatcgttcggataaagactatatcgaagagagagtgaattattataataagctgtcttctccttcttctttgccggaaaagtcttttataaagaatgaatttcggtatttgatctttttaggaactcttgcggacaataaaaaatctctttttcataccgcatatttttttgataccagggaatatacccgttggtttaaacaatctcttcggtggggatattgcccgggcgatgtatatttcactccggaattcccgtctattgtgaaaagccgtttactgaccgattccaatgataactctgttgttatgaaactggataagttcaggcattttatgtttgtaaatgatacaatgcctttttcttctaaaaaggatatggttatcttcagagggaaaatacgacgaagccgtacccgtaaattatttttagagatgtatatggaccatccgatgtgtgactgtggagtcgttggtaaggatgagggagtaccggacgcatggatgactcctaaaaaaacgattcgtcagcatttggattataagttcattatggcattggaggggaatgatgttgcatcaaatctgaaatgggtaatgtcttctaactcgatagcagtgatgccgcgtcccacttgcgaaacttggtttatggaagggaaattgattcctaactatcattatattgagattaaacccgattttacggatttggaggaacggttgaagtattacatcgaacatccggaagaggctcaacaaatcatagagcatgctcatgaatatgtggctcagttcagaaatcctcgtcgtgaaaagttaatatcgctgatggttttggataaatattttcggatgacaggtcaaaatattgaagattgataaaactctattctcctatgatacatatagcatgtaatattgactctaattttacggtacactgtgcagtaactttggtttcactgttcgaaaataaccgtgaatctgagttttgtatccatattgtggcctctacactgccttctgaagataaggaagtactaaaaacaatagcaggtcgttatggcaataaagtacgcttttactttcctccggaagacttgttgcataatttttctatcaagaagtttggtaagcgcatttctatggctacttattaccgttgtatgttctcagccattttaccggaagaggtggataaagtgctttatttggattgtgatattgttattcttggagatatatcagagtattggaatacagatatgagtaattattcggttgcttgtgtcgaagatatcggcagtaatgaagatgaacgttatgatatcttgaaatatgataagtcattctcttattttaatgcgggagtactacttatcaatttgcgctattggcgtgagcataaaatagatgaacaatgtgaacagtattttttacgatatcccgagcgtatccgctttaatgaccaggatcttttgaatgctgttctgcatgaatctaaactttttgttcccttgaaatggaatatgcaggatggtttctaccgttatggggcggataaaggagtgaaagataagaagcaattgcatcaacaattgctccatcctgttatcctgcattatactaataaaaaaccctggaattatgatagcatgcatcctttgaaaggagaatactttaagtatctggatatgactccctggaaaggcaaacgacctttatctacttttaaagctcgtttgtcctggtggttgaagttgcttccttatgcaatgcggttccgtaagcccaagtatatgaagctgtaaatacattgatcaaagcatttgctatctgttgcgtcttttttgtacaattttccggtatataatcattccaattgtatatagtttgaaatgattatatatgcagtatcgtctgatcgcttttgataatccgatgtctttcagactgagatagtcataatggtgacaaatctccattgtagccgcaattatttggtcattaaggggggaaggcctcatgatgacaatatgattgattaagtggaatgctttttttagtagttttaatggcttttccgatacagtttgttcctgtttgacaaattggtattgatcatgcaggatcttaactaactggaattcttcaattggattgaaagttgtgtttgtgaggctgtcggtgcgaattctatagtgatacttaggcgcttgtatcaataccgttttgttagctctatgaaatatcttgtaactgagggctgcatcttcgaaaaattttcccatgggaaagcggagattgttgaataattcccgtttatataacttttcccaaacatagtttcgtataatcttatccttaataagagccatcatggcatctttgtgattaaatgtaattatctctttagactcaaatgcagctttgatctttgttccatattctatatagtgcgcacaggcagatatgtctgcttggtacttacttagaagattataaagtgtttcgtacatatcattttcaatccaatcatcactatccacgaaacctattaaatcaccggatgcaatatcaaggcctgcattacgagcatcgctttgtcctccgttttttttgtgtatgactttgattcttgtatccaatttagcaaatttatcacaaatagcaggggattcatctgtcgagccgtcatcaacgatgatcacttctaagtgggtatatgtctggtctaagaccgattgaatgcattggcttaaaaagggggctacattatataccggaataataatacttattaatggagactcatcgatttttttcatcattaagtagtttatttagttaagtctaggatcatttttacatatatggatgcaaatatagtataatagtagtatatatgtgctcttttaacctaaaaaatgtaaatacaatccgtttgttgtcttggctatacatacttttgtatatgataaagagaagaattttattttttcatggtgagtttcctgctggaggagctgaaagagttacaatggatattgccgattttgtagctcaatatggctatgaaacatatgttattacacatcagattaacagtggaagttattccaatattaaggttattgagtttcaaggtggaggcgatgttgacagtcaggagaatgctgactttatcatacatactctcaactcgttgaaaattgatatcttcattctgcctatttgtcttttaagcagattggattttattaaaagtaaagttgatagtaaattgatctttgcttgtcacagcactcctttctgggaaataacagcccgtctacataggagaaggggtagagcgcgtggttctttctttaaaatgttggaatgggggttattaacttatccaaagatagtatggttaaagaaatatgactctttttttattaatcaatataagtttgtttatgatcaagttgatgcttttactgttttgtgtgaggaatataaacaaatactgcttaataaaatgggagtatcacttgatgagcagaaagtacatgttatatataattctgagagacaatgtccgaatgttaatttgaataagaaaaagcagattctctttgttgggcgtatgagttattatgataagcgggttgaccgtttgttggatatttggggaatgatatataaaaaagtaccggattgggaactgattttagtaggaggtggaaaagaacttcctctacttcaagctaaaagtcaaaagatgaaacttcaacgaatacgttttgcgggacatagcgatcatgtcgatgatttctatcgtgatgcttccgtattatgtttgacttcagcttttgagggatggccactatgtttgacggaggctcaggcgaatggtgtcgtacctgtagcttttgattgtgtagccgggatacgccagattttgtcgccttcaggagttaatgggtgccttgtaccttcttttagtttacataaatatgctgagatgttattgtctctgttgatggattcggaaaagttacaaaagatgcggaataacgtgattttgaagtcaaaagagtactctcctgaaattgtcggacaaaaatggctcggtttgttcgaatcattgttataatctcttttgtatgaatacctttttaggagaatataagtttaaacttttctcttcttgggaatcagtttgcgataaagtgtcattcctattttatatattctgaaatgatgataaatgaaatatcgtttgatggttcttgacactccgatatcttgtggttttagataatcatattggtgcataatctctaatgttttgtcaatgacctcattgttgagtgttgaggagggtagtataatcgtgtgattgattaagtggatgcttttctttataatcattacaggtttatcattgattagttgacgttttttcatgaattgatattgttcgtgtatggcttgcacatattgtattcctttgagagggctgaacgaagaattagtagtgcttccccaacgaattctgtagtgatatttaggtttgtattttaatacagttttgttggatctatcaaatatcttataacttagggatatgtcctcaaaaacttgtccaatagggaaatataatccggtaaataggtcacgtttatataatttttctacgacataattttttataatcttatcttcaaacaatgttttcataacatctgcatggttgaaagtcattatttcctcttgcgatctgtagacagttggtctgccatcctcatattccagataatgtgtgcaggcagatatatctgctccgtattgactgattagattataaagtgtctcatacatatcgttatcaatccaatcatcactatccacaaaaccgatatattctccggatgctgtgtctaaaccgatatttcgggcgtcacttaacccaccattttttttgtgtatcactttcacacgagcgtctaaggctgcaaaatggtcacaaatagcaggtgaatggtctgtggaaccatcatctacaacaataatctccaggttagtatatgtctgatccaaaattgattgcaggcattgatgtaaatatgcctctacattgtatacaggcacaataatgctgataagggggagtgttcccgatttttccatttttatttaggtttagtaatatgctattgtctttgtacgttgcaaagataacatattgtttttgtttttctgaatatatatttgatagctttatgggatgcgtggttgtttttgcagtataaaaagagagcatctgcttaattcgccactgactttctactctctgaatagtaacttgctgaatattttctgttatctttgcaacttaatcatttaatagtaagtaatgaaggaattttttcaacttatgcggcgttttgtaccgccttacaagaagtatgtaatatgggcgttgatactgaatttattctcggccattctgaatatattttctttttctttgatagcccccattctacagatattatttaaggttgataaagatgtatatgagtttatcccatgggatactgcttcaattagtacaaaggaccttctgataaataatttctattattatgtttcagatatgatccagatcaatggcgcttcttttactctgatgttgttaggactctttttagtggtaatgactttctttaaaacattctgctatttcgcttcgtcagccgtgatgattcctttgcgtaccggtgtggtacgggatattcgagtgatggtctatgataaagtgattcgtttgccacttggattcttctcggaggagcgaaaaggagatatcatagcccgtatgagcggggatgtgggagaaatagagaactcggttaccagttcattggatatgttggtaaagaatccgatcttgataatcgcttattttactacgctgcttgtaatcagttggcaactaacccttttcactttattggttgtaccattgatggggtgggtgatgggtacggtaggcaaaaaacttaaacgtcaatcccttgaagctcaggcaaagtggagcgatacgatgtcgcaactggaagaaacattaggaggacttcgtatcattaaggctttcattgctgaaaataagatgatgaatcgtttcctgaaatgcagtaacgagtttcgggaggcaaccaataaagtggcgacccgtcaggcattagcccatccgatgagtgagtttttaggtacgaccatgattgtaattgtgctttggtttggcggttcactgattttgagcagtcattcttctattgatgcttctacttttatggtatatctgaccatcctttatagcgtaatcaatcctttgaaggaattttcaaaagccgggtataatattcctaaaggtttggcttcgatggagcgtgtggataagattctgaaagcggaaaataagattgtggagattcctgatccgaagccgctgaatgggttaaaagagaaagtcgaatttagggatatttctttcagctatgatggaaagaaagaagtgcttcaacatattaacctcactgtacctaaaggtaagaccgttgctttggttggacagtccggttcagggaaatctacgttggtagatttgttgccccgttatcacgatgtacaggaaggagcgattactattgacggagtcagcattaaagacgttcgcatctccgacttgcgcagcctgatcgggaatgtcaatcaggaagccatcttgtttaacgatactttctttaataatatagcttttggtgtagaaaatgctacgatggagcaagtgattgaggctgccaagattgccaatgctcacgattttatcatggagaaagaagacggctatcatacgaatataggtgaccgaggcagtaaactttccggaggccagcgtcagcgtatcagtatagcacgggctatcttgaagaatcctccgattttgattcttgacgaggctacttctgctttagacactgagtcggaacggttggtgcaggaggcattggagcgtttaatgaaaacacgtactaccattgctattgcccaccgtctctctaccatcaagaacgcagatgaaatatgtgtattatatgaaggagaaatagtagaacgtggaaaacacgaagaattattggctaagaacggttattataaacgcctgaatgacatgcagtcgctgtaggcatggcagagagatagtgaactccctcactttttaataataacttttttgctaaggcgggtagggcaaggtggatttgccctaccggggttataggctaattcgatatcagaagaaagaatctttgaggcggttgaacgttatcatgtttgaaagaaattttttcggtatattcttttcgggatttatttgttattgggggtgatacgatacaatccttatttccttccgaagtctgccgggatttctccccattgcttggtttcccacttcaatattggggtggaatatttattttctttaagccatttttctgcacgttctatcaatccgaacaatttttctgtttcagcggtccggggaagttttgtcttgcattttttttgttttacccagctgattgcatttgcgctatcgctatagataggcatgtcgaatcctttctgtttcagtaaagcgagtccatgtaccaatgccagaaattcgccaatattgttagtccccttcatcgggccgaaatgaaaaatctcttgtcggcttgcgacgtgaacgccacggtactccataggtccaggattaccactgcatgctgcgtctactgcaaggctgttttcaatgaccgctgccgggagtgtgtctgggggggtaggggaatcagctgttttcttcttagcattcttgccgatataagcataaggtgatgaagcaaaagcacgttctgcttcctcccggttatcgaaagatttatatttggcactatcatatcctttcacctgcagctgacattcggtccaggatgtataaatgccgggagttactccatcccatacaacgtaatatttttgtttggccatacttggtgttttcagcttattgggcagtaaaggtacgaatatattctattaccgaacaactttcgtttataggttgttttaatttcaaagaaccaatgtaaaaaagaaaggagtatttttatgaaaaaatccttcgaagaggccctcaagcatagaaggacctattattcgataacaaatcagtctccggtttctgatgaggagatagagcggattgtcaatcttgctgtaacccatgtgccctctgcatttaactctcagtccactcgtgtagtgctgttgttgggtgagaatcacaagaaactatggcatattgtaaaagaaacattgcgaaagattgttccaccggaagtttttaaaacgactgaagctaaaattgataattcttttgccagtggttatggaactgttttattctttgaagaccagtcggttgtgaagggactccagaatgctttcagtagttataaagataattttccggggtggtcgttgcaaacgtctgcgatgcatcagttggcggtttggacaatgttggaagatgccggtttcggggcttccctgcaacattataatccactaattgacgaagaagtgcgtcatacctggcacctaccggaagagtggcacttgattgccgaaatgccgtttggacttcctgtgcaaggaccgggtgataaggattttaaagatctggattccagagtgaaggtctttaaataaggtatattcatttaatcggaaggattaatatcgttttatttttggtaagaacttactgagtagcgttacatggctttgtctgcaatgtgttatgattaagtttgttatgaagaagaacagtgtccttatcccggcccgggtagctgtgcccatgggcccgcatacccgggctcatgggcacaggtatgcgggctcatgggcctgcgcacccgggctgggataaagaaagaagcataaacagaagaggtattaaggaaaataaaatggtataataggcgaatatagatagggaactaatggtatgctattgggaatcagtggaatattccgagttttacctaaaaaaagagggtggaagatggaagatagaggtggaagataaatgccttgaaaatgcgatcttccacctctttaatttattgatagccacctgctaatgttccgaaaggtggaagatggaagatcgaaatgcatttcttgtatgaggagtacgtataggattgtctttattttcatgcttgcatgcgcaaagttaccatccgggttattggttgttctattaataaatatctatctttgcatcaaaatgccgtttgcttatgattcgtatatttctgaccggctatatgggggccgggaaaactacgttaggaaaagctctcgcacgagaactacatgtcccatttatcgatctggactggtatattgaagaacgttttcacaaggcggtcggagaattatttaccgagcggggagagtccggctttaggaaacttgaaaagagcatgttacatgaggttggtgaatttgaagatgtggtaatctctacagggggaggagcgccttgctttttcgacaacatggagtatatgaaccgggttggtactactgtttttttggatgtagaccccaaagtgctgtttcgtcggttacgggttgccaagcagcagcgccccatactgcaaggaaaggaagatgacgaactgtttgattttataatacaggcgcttgaaaaacgttcatctttttatcgtcaggctaaatatattttctgtgctgacgaattggaggatcgcaagcagattgaaacttccgtggaacaattgcgcaaacttctggatttgcacatagtaagctaaactctaagaaaacttattttctgattcggcaatcattctttttcttctctattttttgttcagtcgaccaatattactatcttgcagtcgctgtgaggttttgtgccttccggtatcttacaacccaaataaaacgatcagacaattatggaaactttaaaagagaaattcgaagccttatcccgtcaagtccgggcatccgggaaacctgccgccgcatggttccctcagtttacacctgctacattgctgaatgccgaaaactggtgggaagcacttgctgtatgtgagtacgcattggatacacaggaagatgaaacgctcacagctgacttttttgaacagatattcagtgcatacgattgtaatgtagaggtggatcttaatgaagaagagtatgcttattggtgggagaaggtgataagtatatgcgatcgtgtagctgtatttaacggtgccggttggtcgcagaaaggtgcgcaatattcagaagcccgttatgggacacgtgatctcagtctcttatttccttattatgagaaggcggcagctatgggaagtccggaagctgaggcaaccgttgcctattggcgttatatgggcttctattgtgaacaggataaagcggaaggagagcgccgctttgaggctctgtcttcacccgaggctgtgttatggggaaaatactaccgggcctatgccgaacaacacaccggtagtaaagagaaagctttgcttatgcggaaagaactgcttggtgaactccctgaaggacaccgtctgcgtgctcatgtttatgccgctatgggcgatgcactggacgtagaagaaggaaatgtggccgaagaggcagcatgctatgagaagtctcttgaacttgttcctaatttatattctctcaagaatctggctacgctctatttccgttatccggaacttggtaaaaagaaagagctggcgtttgagttatgggagaaagcctggcatgccggtgtatggtctgcagccaatttcctggggtataattatcaggaagaagagtggcttgacatgcctaaagccattgaatggttggagaagggaatgctttactgcgaatcgtattgcgcctatgaattagctttgatttacctttataatgatgagtataaaaatgtagaacgtggtttgatgtgcctgcagcgttgcattgacgataattatgtagaggcttttgagactcttgctaatatttactttaacggtgaattggtggaagaagatatccaacgtgcacggcagttgctggagaaagctattgaattggggtccggtaatgcggcctaccgtatcggttggatgtatgaacgcggattactttccgaagatccggattacctgaaagccatggagtattatgagaaggcggcatctatgaataatgctgacggatactcccgggcggctctttatctggctaacggatacgccggtgttacggatgctgagaagtcaaaagcctattatgaaaaggctgcggggttaggttcatgctttgcattggtagagttaggattcttatatgaaaatggagatgtggtagaacagaattatgggaaagctttcgaattgtttcagaaagccgctgaggaggagtacccttatgcgatgtatcgtgtaggtctttatttggacagaggaatcatcggtgaaccacaacccgtagaggcattcgcttggtatgaaaaggcggccggaaggggagacggagatgcaatctttgctctcggacgttgctataagaatgggattggtacggaagagaatccggataaggctctcgaatggtttgctaaaggggcggagaacaacgaaccgcgttgccttacggagttaggactggcttatgaatatggcagtggggtagaagagaacccgcatcaggcagttgaatatatgaccaaagcggccgaacaagattatggctacgctcagtttaagatgggagattactatttctttggttatggcgcttgtccggaagataataaacaggctgtggagtggtatgagaaggcggtcgccaatgatattcccttagctatgctgcgcatgggtgagtactatctctatgactatgacaaactgaatgaatcggagaaggctttcaactactttaaaaaagctgctgagtcagaatgttataacgaagggctgggaatctgctacgagatgggaatcggggtggaggacaatgaaaccgaggcgtttaaatattacacgttagctgcggacagtggaaatgtcatgagtatgtaccgcaccggattgtgttattacaatggagtcggtgtaaaacagaattatgcagaagcctaccgttggtttaatgatgctgccggaaatgagaatgtggcttcttactattatttaggcaaaatgctgatgtacggtgaaggttgtgtgcccgatgcggaaacaggtattcaatggctgatgaaggctgcagagcataacagtgataaagcacagttcgaattgggtaatgcttatctgatgggaaacggagtagaggaaaatgatgagattgccatggagtggtttgagaaggctgctgagaatggaaatgagaaagccttgaagattacaggaagaagacaacgctaaagtaaaatggaaaaagaaggtaataatctgtttcaggtcaatctaaaagggatgattgccctgttatcagaacatatttatagtaacccgaatacctttgtcagggagttgttgcagaattgtgtagatgctattaccgcacttcataatatcgacgaaagttatgccgggcgtattgatgtttttctgaaagaggacggttcggtggtctttcaggacaatgggatcggcttgaaagaagaggaagtccatcgttttcttacggttattggtgaaagctcgaagagagatacccccgatgcagacgattttatcggtcggttcggcataggcttgctgtcttgtttcgtggtgaccaatgaaattagggtagagagccggtcggcaatgggaggaagccccgtctgctggtgtggaaaggtggatggcacttatcagaccacttttcccgaagaagagtgggcgataggttcaagggtcgtgttgtgccccaaaagtgagtggactcatttgtttgagtatgaagtgttcaagaaaatactgatcagttatggagaggtgttgccttacccgatttatctgcatcgtggagaggaagaagaactggttaataccccgtcaccggtctggctcaatccgaaagctacccgaaaagagttattggactatgggacgaaggtttttcagtcgtctgctcttgatgtctttcgtatccgtacagagagcgggcgggtagaaggcgtactctacgtattgccttatcgtacacaattttctgtacgtaactcgcataaggtgtatttgaagcggatgttgttgagtgaagatgattgtaaccttttgccctcatgggcattcttcattcgatgtttggtaaatgccgacgggcttctttctactgcgtcgcgcgagtcgtttgtcagcaatgatttattgaaagatgcccgcaaagagatcggggttgctattaaggagtatcttcgaggattggtgcagaacaatcgatcggtgtttgacaaaatactggatgtccatcatttccatattaaagccatagcttcggaagataatgaactgctacgtttgtttatggattacctgccctttgaaacgaacaggggaatacgaagtttcgggagcatccgttcggcggggaataccattggctatacacgtaatctggaagacttcaggcaagtacggagaatagccggtgcacaaggccggttggtgatcaatgctgcctatacatttgatgaaacgctgttaaagaagtatgcccgtcttaatcaggaactgactttggaggagatctcacccgctcgtctgttggagcagtttgctgaagtggaaggtaacaaagaacaccgggcctttgaggcaaaagccagtgagctgttgaaacgttttggctgtatctgccgcttgaaacattttacaccggtggatactccggttatatttgtggccgaagagaaagaagagaacagcaaagtcgccaataatccgttggcagcagtactgggttcggtaaatgctaaaaaacgcttaccgcctacattgactttcaatgccgataacgagatggtacagacattactgcaaattcaaggagacaataaactgtttcagcatgtagtgtgtattctttatgtacaatcgctgttacaaggcaaatatcctgtaaacagtgaggaaatggaacttttcaatcactctctttctgaactgatgactactaaaatgaatgattttataaacttcctcaattaaacaaaagtatgaaatacacacttgagatacaaaagctactgttgcaggcacaaaatgataacctgcatccccgtgagaaagccaatctactgaaagaggctgttcgcattgcagatgagaatgaagatatacaatgggctgtagagatgaggctggaccttatctatgaattgaatctcctctcggcagatgctgaagagatcgcggtgttctctaaaatcctggacaactatgaaaaccataaggatttgattaatgaggatgatatcttatggaaatacaaatggatatggtcttgtacttttgatcttcccagtataccgatggagcaggtggaagcggtgggtgaagattataaaacccgtattttgcgcaatggttattcattgcgtacatattatcaccggttgtctgtggaatacactaaaatgagggaatatacgaaagccaaagattacatagataagatgctggcggaaaagatggatgacctgacttgtgaagcttgtgagctgaacttcatgttggattattatcttgaaactggacagtttgaagaggcctataatcgtgcgcaacctttaatttccaagcaaatttcttgttacgaagccaatctgagagcttatctgaaattggcatattatgcttataaagccgggaagccggagatagcggcggatatgcgtgcacgggccgaagaagctttggcgggaagagaaaaagatgaatatctgcttctttatcttgggctattcattgcctattattttatgactgatccggacagaggctgggagtatgtagaacgttgtatcccatggagtctgaatactaatatgcagaaaagataccgtttctcgtgtgatatggtggaggctctaaactacgagcagcgtgaagaggtcagtctggctttaccggaggattttccactttaccgggttgacggagtatattctgtggctgcgctacgtaattatttttatagacaagcggatgaattggcaggcttgtatgatgcgcgtaacggaaatagcggatatcaggaacgattatttaatatcaatttaattggcaacctgtagattaatacgtatttttgccgtccaattatttattaaaaacaactgaataacagaaaaatgagaaagtggcgtattgaagattctgaagaactttacaacatcacaggttgggggacttcatactttggtattaatgacaaaggtcatgttgttgttacaccgcgaaaagatggcgtagccgtcgatttgaaagaattggtcgacgagttgcagttgcgtgatgtggcggctcctatgctggtgcgttttccggatattctggacaaccgtattgaaaagactgcctattgttttaaacaggcatccgaagagtatggatacaaagcccagaattttatcatctatccgattaaagtgaatcagatgcgcccggttgttgaagaaattatcagccatggcaagaaatttaatttgggccttgaagccggttccaagcccgaactgcatgcagtgattgctgtcaatacggattctgactctcttattatctgcaacggctataaagacgaaagctatattgagcttgctttgctggcacagaagatgggtaaacgtatctttctggtagttgaaaagatgaatgagttgaagctgattgcccgcatggcaaagcagctgaatgtacagcctaatattggtatccgtatcaaattggcttcttcaggaagcggaaagtgggaagagtcaggaggagatgccagtaagttcggactgacttccagtgagttgcttgaggcacttgattttctggaaagcaaaggcatgaaggattgtctgaaactgatacacttccatatcggaagtcaggtgacaaaaatacgccgtatcaagacagcattgcgtgaagcttctcagttctatgtgcagctccatgcgatgggtttcaaagtggaatttgttgatattggcggtggtcttggagttgattatgacggcacccgttcgtcaagtagtgagagtagtgtcaattactctattcaggagtatgtcaacgactctatttccacgttagtggatgccagtgacaaaaacggtattccccatcccaatattatcactgagagtggcagggctctgactgcacaccactctgtcttgatttttgaggtacttgagacggctactttgccggaatgggatgatgaagaggagattgctccggatgcgcatgaactggtacaggaactttatggcatttgggatacattgaatcagaacaagatgcttgaagcatggcatgatgcccagcagatacgtgaagaggcactcgatctgttcagccatggtatcgtagacctgaagacacgtgctcagatagaacgtctttactggtctattactcgtgaaatcaatcaaattgccggtggactgaaacatgctcccgatgaattccgcggattgtctaaattgttggctgataaatatttctgtaacttctcactttttcaatcgctgccggattcttgggcgatcgaccagatatttccgattatgcccatccagcgtttggatgaaaaaccggaccgctcggctaccttgcaggacattacctgtgattccgatggaaagatagccaattttatctctacccggaatgtagcacattatatgccggtacatagcttgaagcagaaagagccttactatgtagcggtctttttggtaggggcttatcaggaaatcctgggagatatgcataatctgtttggagatacgaatgcggtgcatgtttctgtcaatgagaaggggtataatatcgaacagattattgacggggaaacggtcgcagaagtgctcgattacgtgcaatataacccgaaaaagctggttcgtactcttgaaacatgggtaacaaaatctgtgaaagaagggaagatttctgtagaagaaggaaaagagttcctttccaattatcgttcgggcttgtacggatacacataccttgaataaataaaaagaactatcattttataaatgacgagctacaagttacgaatactgcacatgatatcagtctcgtttcttgtagctcgtggcttgtaacctgatggagtataaatcgtaatttgtaaatagaaagaatatgaaggaaaaactgacagtcattaaagttggtggcaaaatcgtagaagaagaagctacattgaagcagttactggatgattttgctgccattgaagggcataaggtacttgttcatggagggggacgttcggctacaaagatagctgctttactggggattgacagtaaaatggtcaatggacgccgtataaccgatgcggagacactgaaggttgtgacaatggtctatggtgggttggtaaacaagaatattgtagccggattgcaagcccgtggggtcaatgccttggggttgactggagcggatatgaatgtaatccgttcgatgaagcgtcccgtaaaagaggtcgattatggatttgtcggggatgtagagcaggtagatgccacattgctttctgatttgattcataaaggagtggttccggtgatggcaccgttgacacatgacggacaagggaatatgttgaatacgaatgcagataccattgccggagagacagctaaagctctttctgccattttcgatgtgaccttggtttactgctttgagaagaagggggttcttcgtgatgaaaacgatgatgagagtgtcatttctcagatcaatcgtgccgagtttgaacgatatattgccgaaggcgttatccagggaggcatgataccgaaacttgagaattcttttgaagcaataaatgcaggtgtatctgaggtgataataaccttagcgtcagccattcacaaaggtggaggaacccggataaaaaaataattcaaaaaaaagaggaatacatctgtaacttttcaccaactcacccgtcaacttaatagagatgcaagaaatcagcttccgagacgacatattgccattgaaagataaactctttcgtttggcactccgaatcaccttcgacagggccgaagcagaggatgttgttcaggatacgatgattagagtgtggaataaacgtgaagagtggacacagttcggatctattgaggcttattgcctgactgtggcgaagaacctggccatagaccgaagccaaaagaaagaagctcaaaatgtggaactcacaccggaaatggaggaagaatccgaggcatccggtccttatgatcagttgattaataaggaacgaatgtcaatcatccatcgtctgattaacgaacttcctgagaagcaacggcttattatgcagttgagggatatagaaggggaaagctataaagaaatagcgaaaatcttgaatctgacagaggaacaggtaaaagtgaatcttttcagagcaagacaaaaggtaaaacaaaggtatttagagattgatgaatatggattataagtatatagaacagcttttagagcgatactggcaatgtgagacttctttggaagaggaatcggaattgcgatctttcttttcggaggaagaggtacccgctcatttgctccgttacaaggacttgtttgtttatcaggcagttcaacaggaagcagggctgggagaagactttgatgaacgtattctggctcaggtagaggcacctgtagtaaaagcaaaacgtctgacgatggttggaaggtttatgcctttgtttaaggctgccgccgtgattgcgttgattttgtcattgggcaatgtagcgcaacatacattctttgccgatgaggctttggattataattatgatgcttataaggacacatacgatgatcccgaagtggcttacaaacaagtttcttctgctttgatgatggtgtctgaaggtataaataaatcacaggatcaaatcgccggagatagtgtgaaggttgaatcgattcgagtgatgaaggaataaaataatgaagagcgttcttttaatgtgctggatggcattgctgtctgtggctgtttcggcccaggactttgcttcacgttttatggctgaacataaggcggattctaatctgacttgtgttacgatcagtccgaaaatgatggaggagataatgaagagcgatgctgagaaagataaagaggtgctggatatgatctctaatctcaagagtatgcaggtgcttacttctgatgtggaaggaaaaaagtattttgatgcagctttgaaggtggttgagaagaataccggaaggtttgaatcgtttctttcttttaaggataaatctgagaattgtcagattatggttcgtaaaaagaaggatacaattgttgaactggtgatgctaatgcacgaaaagaatcattttgctgtaataaactttaccggaaatatgagtccggagtttattgcacagataaagagacattttcatttgctttaaacatataatatagttagtgtgcttaattaaaacaactttttgatttgaggctgtgaagtttcaattctctcaatttcaataaaaaactaactaaataaatgggctaccgcgtgatgcagtagcccttttatgtttatgctacgtcgtcttcatagagcgaagttaaactaagagagagtttctatatttaaagttttcgtaatcctctttttgaaaagtttatttgcggattacctttgtatgccacacttccacttccactgacacctcctgtcaggttttcagtagcatgacattttatgctgcccgaaccactgatatgtgcattgacatcttctgtctttaaatctatggcattaatatctcccgaacctgcaatacgatactcggctttgcccgatttgccgttcagcaatacatttcccgaacctgaaatatttgcttctgtgcatggtacatcgatttttttcaaattgatgtttcctgaaccgtaaatatgcgttgacaattttgtacaagagaaattggttccattgatgttccccgatccgtaaatgcatatttctaaatcgtcgttgctcttcattccatttgtaaaggtcgtgtttcctgagccatatatggataaatggtttaatgatggagaagatactctgatttccagttttccgctattgcggatggagctattctttttaaatttaaccaccagtgtttttccttcaacagtggtttccaataactggacgatgttgtcgggaccataaatctgtacagtgggagttccttgcttttgtgtataaacaatatccgaactgctcattgatttaattttgctgaaagaaccgactcttatgtctttagtgatatagtttgaacttccacttacctgctttgtctgtgaacaggccccaatgattaataacagcatggaaattgtaaggcatgataataattgttttttcatggtcttgtgattattgtattagatattcttaatagttcccactccttttttattgagtgattttatggtaggattacctttatacttaatgcttcccactcctcgtacagctgcattgatagattctactgcgttgcaggtaatatctcctacaccctgtgaactggcttctactatattggcctgcaggtttccggcttctatattgcctacccctttagagtgaagagtagctgcctgaactgttccttcaagttttacatttcctacacccattgattgcacatttaagctactgcagattagtgatttaatttttatatcacctactcctttgctttccacatagaggttgtcggtagtcaaaccgttatcaatatgtacatcacctactcctttgaaggaaatactgtttaaagttggagatgtaattgttatcttcatctttttgaagttgcgtacctttttcgatttatcgatgcttaacaataaggtactatcttttacagctacctgtattaacgccacaatgttatccggcccatagatttgtacgtctgtttttccatctgcggattgtgtgtaatagatgtcacctacggtccccgcgtcaattttgttgaactccttcactttataatctctcgtgatgagttttttactgggttgaataccttcacccatatatacgcaactgctcaataaccctgctgttaacagtaatgttgacaacattttaaagattgttttcattttatttcgtttttagaggtttctattagtttagacgtaggttgagtaggaaaagttgcatctatctttcttttttctgcaaaataatccgtttatttgtatttataattaagaacaacattggataagattattgaagataaggagttaggacgtctgatcgtacgtgataatgtgcgtgccaagagactcgtttttcgtacaaaagctgatgcgatctatgttagtatacctccgggagttacgatgaaggaggtaaaggaggcgatagagaaattacgttccagattgttggattccaggcagaagttgatacgtcctctgattgacctgaactatcggatcgagacagaatacttcaagttatcattggttagtggtaagagggagaaattcttggctcattccgaattgggagaaatgcggattatttgtcccccgacggccgattttacagattctaatttacaggactggctccgtaaagtaattgaagaagctttgcgacggaatgcaaagattatcttgcctccccggttgtatatgctttcggagcggtatgggttgccttacaaaagtgttcagataaattcaagtcgtggacgatggggaagctgctcttctcacaaaaagataaatctctcttattttcttgtattattgccaaagcatttgatagattatgttcttttgcacgaactttgccatacttgtgagatgaatcatggtgatcgtttttgggatttgcttaatggtttcaccggaggtaaagctttagagctgcgcgaagagttgaaaaaatataagactgagatttgacattgcaatcacaaaacagatgttgcaagaatcctttccaccaaagattacactgattgttacagattgattgccggcattgataatcggttttgggctttttcatctgtgcgaatcggaataattctgtagtgtcttttgatatctccctttacagtcttttataccctatgcggtcaggaaaaaaacgtctttctatttttgtggtagctgtttgataccgtcaatatccttttcaaaacggtaagtaccacctttttcactcagatcaaatgcggctactgtttcagtctgattatttacaatcatcagtgcactttgctctgcgaagcgtccgacttcgatagcagtaggctcttctttaatctgtttattcatgatcaagctgtcattgacaaacagtgagatcgaatcacctacgaagccttttgtcagctgaatggagtacgtttcactaaagtgacggacagcttctttttcccgttgcaatctcagactcatatatacaaagatgactacgacaaatatgacggcaaatgctaaaatgccgtttcctaccataaattgcttgttagtgttaagacgatgtgccataatactatattctttaatattcggggtaaagatagcaaatctttttgtatctcatttgtttttgtgtaagtataaaagttacaaaaaaataacgagatctctgaattctaatgcttttgtgttatataacatatcagtttacattgttcgagcagaataaattatctttctttgtatcgtgatagttcagcatagctatctataattaaaaacctttattgatacgtatgaaaataacttttggacaacaaacgaccaaagtaaagcaattggctgacaagattagctttgatatctcgatgggagtatataaatcgggagattcactgccatcgatcaatcaacttagccatgcgtatgaggtttcccgagatactgtatttaaagcttttcttgatttaaaagagagaggaattattgattctactcccgggaaagggtattatgtggttggaagattgaaaaatgtacttcttttacttgatgaatattcaccttttaaatatgcactttataatagttttgtaaagcgtttgtctatccgttataaagtcgacctattgtttcatcagtacaatgaacgtttgttcaataccatcattcgtgaatcgttgggacgatacaataaatatattgtgatgaacttcgataacgaaaagctgtctcctaatctttataagataaatccatctaaacttcttcttcttgatttcggtaaatttgagaaagaggagttctcttatgtttgtcaggactttgaccaaggattctataatgcgctacttcaactggcagatcgattgaagaaatatcaaaaactcgttttcgtgttagtgaatgatagcatgcatccccggagtagccgtgacttttttgagaaattctgtgccgatcaacatcttggttgtgaggtagtgagtgatattgaaggacttcaggttcgcaaaggagaagtatatatagcgattcgtcaaatagacgtggtgagtattattaagaaaagtcgtattgagggtttacaatgtggagttgattttggcttaatagggtataatgacacacctgcttatgaagtgatagatcagggaataactgcattaagtgtagattgggagaaaatgggtgataaggctgccgaatttgttctgcagggaaaagccatacaagattacctgcctacggaagtcaggctgagagcttctttataaaagagtttttcagaattgtgtgtcagcacaggtcagcatggaagaattgtctaatgaatttaataatatagtatgaaaaagtatccgaaaatcgggattcgtcccaccatcgatggacgccagggtggtgttcgcgaaagccttgaagaaaaaacaatgaatctggcaaaagctgttgccgagttgattacttctaatctcagaaatggcgatggaactcctgtggagtgtgtgattgcagatggaactatcggacgtgttgccgaaagtgctgcttgtgcagaaaagtttgaacgtgaaggggtaggagctactattactgtcacctcatgctggtgttatggggctgagacaatggatatgaatccatattatccgaaagctgtttggggattcaatgggacggagcgtccgggagcggtgtatctggctgctgtgctggcagggcatgcacagaagggattgcctgcatttggtatttacggtcgcgatgtacaagacttgaatgataactctattcctgcggatgtggcagaaaaaattctgcgttttgcccgtgctgcccaggctgtagctacgatgcgtgggaagtcttacctttctatgggtagtgtttctatgggtattgccggttctattgtaaatccggacttcttccaggaatatttgggtatgcgtaatgagtcggtcgatttgacagagataattcgccgcatggccgaaggcatttatgataaggaagaatatgccaaagcgatggcttggactgagaaatattgcaaaaagaatgaagggcatgatttcaatgtgcctgaaaaaacaaagacacgtgtgcagaaagatgaagactgggagttcattgtcaagatgactatcatcatgcgcgatttgatgcagggtaatccgaagttaaaagaacttggatttaaggaagaggctttaggacacaatgccattgcagcggggttccaaggacagcgtcaatggacggatttctatccgaatggtgatttctcggaagcattgctcaatacttcattcgactggaatggtattcgtgaggcttttgtcgttgcaacagaaaacgatgcttgtaacggtgtggctatgctgtttggtcatctgctgacgaatcgtgcacagattttttcagatgtacgcacatattggagtccggaagcagtgaaacgtgtgaccggtaaagagttgacaggaatggctgctaacggtattattcacttgattaattcgggggcaactactcttgacggaaccggacagcagacgaatgctaacggagaacctgcgatgaaaccttgctgggaaattacagaaggagaagttgagaagtgtctggaggctactacctggtatccggctaatcgcgattatttccgtggaggtggtttctcttccaatttcttatcaaaaggaggtatgcctgtaactatgatgcggttaaacctgataaaaggtcttggtccagtgctgcagatagccgaaggttggacagtagagattgatccggagattcataaattacttgacgaacgtacggatcgtacatggcctactacctggtttgttcctcgtttgtgtgataaaccggcctttaaagatgtatattctgtgatgaataactggggcgccaatcatggggcgatcagttatggacatattgggcaggatatgattacattggcttccatgcttcgtattccggtttgcatgcataatgtagaagaagaccagattttccgtccggcggcttggaatgcttttggtatggataaagaaggagcagattatagagcttgtactacttatggtcctatttataaataacctttagaagagtacaacatgattaatcgatttatattaaacgaagtttcttacttcggtccgggagcacgtgaagtgctcccaaaagagatttcacgtttggggctgcacaaagcatttgtcgcaacagacaaagatttgataaagtttggagtagctgacaaagtacttaaggtgctggaagctgccaagattccttatgaaatattcagtgagattaagcccaatcctacagtgtcgaatgtgaaagccggtgtcgaggcatttgcatcttccggtgcagactttattttggctataggtggcggatcttctatggatacggcaaaggcgattggtattattaccaataacccggaattcagtgatgtcgtttcattggagggagtggcagataccaagaagaaatctgttcccatcatcgcgttgcctactactgcaggaactgcggcagaggtgactatcaactatgtgataacagatgaacagaaccagaagaagatggtttgtgtagatcctaatgatattccgtctattgcgatagtggatgctgagttgatgtacacacttcctaaaagtctgactgcagctacgggactcgacgcactgactcatgctattgaaggtttaataaccaaaggggcatgggagatgagtgatatgttcgaaattaaagctattgaaatgatcaatcgttatcttgtgactgccgttgaagaaccatcgaatgcagaggcacgtaacggtatggcagtggctcaatatattgcaggtatggctttttcgaatgtaggtttaggagtcgttcatggtatggcacatccgttgggagctatattcgatattcctcatggcgtagccaatgcgttgttattacctattgttatggagttcaatgctccggctgctcttgacaaatatgtagagatagctaaggctatgaacgtgtattctgcaggtatggctaaagaagaggcagctaaagcagccgtagatgctgtaaaagcactatctttgagggtcaatattccacagcacttgtccgatttgggcattcaggaaagagaccttgaccgccttgctacagctgcgtttgctgatgtctgtacgccgggtaacccacgggaagtaacaaaagaaattattcttgatttatataagaaagcattatgataactaatgaacatatcgagcagtatcttgctcaggcacatcgctatggcgatgctaaattaatgttgtgcagcagcggtaacctttcatggagaatcggtgaagaagcacttgtttccggaacgggttcttgggtaccgaacctgcagaaagaaaaagtatctgtttgcaatattgctacgggtataccccagaatggagtaaaaccttctatggaaagtacttttcatttgggaatccttcgtgaacgtccggatgtaaatgtagttctgcattttcaatcggaatatgctacagctgtttcctgtatgaaaaacaaaccatcaaatttcaatgtaactgctgagataccttgtcatgtcggtaaagagattcctgtcattccttactatcgtccgggttcgcctgaactggctaaggctgttgtggaagcgatgaaagaacataactctgtgttgctgaccaatcatggacaggtggtatgtggcaaagattttaatcaggtgtatgaacgggcaactttctttgagatggcttgccggattattgttcaatccggaggagactattcggttctgacaccggaagagattgatgatctggaaatatatgtgttaggaaagaaaacaaaatagaaaataatgacgaccagcttatgagtacatacttagcagctgactttggtgggggtagtggccgtattatggccggtaccctcactgaaggtaagctaaaactggaagaggtatatcgttttggtaatcggcaaattagactcggaaaccatgtctattgggattttctttctctcttcgaagaaatgaaaaacggacttcgtgtcgctgcccgaaaaggctatctggtgaaaagtatcgctatagatacttggggagtcgattttgggctgattgacaaagatggtaatctgttggggaatccggtttgttaccgtgattctcgtactaatggtatgcctgagcgggtgtttaagcagattgatcaagctgcccattatgcagaaacaggtatccaagtgatgcctatcaatactctgtttcaactatatagtatgaagcagaacaacgatgtacaactccgggtagctgataaactattatttatgcctgatttgttcagctatttccttacaggaacagcgaataatgaatattgtattgcttctacttctgagttacttgatgcttgtcagcgcaactggtcggataacttgattagtgaattaggattaccccgacatctttttggtgacattgtgcttcccgggactattcgcggtaaattgaaacaagaaattgcggatgaaaccggtctaagctgtattgatgtcgttgccgtcggttcacatgacacagccagtgccgtatttgccgttccttccaatgagccggatcgggcttatcttagttcgggaacctggtccttgctcggaacagagattgaccaaccgattttgacggaggaagcacgtttgggaggattcacgaatgagggtggcatacaaggcaagatacgctttctgcagaatataaccggactttggattttacaacgtctgatggctgagtggaaggagcggggtgaagaaaccagttatgatcgtgtgatagccgaagcaacgctatcagatatccgttcggtaattgatgtagatgattcttctttttgtaatcccgactgtatggaagagtcgatcgttatgtattgtcataagcatcatttgagagtgccggtttctcagggagagtttgttcgttgtgtcattgaatcattggcacaccgttataaattaggagtcgaacagatgaatcgctgtctgccggtgccggttaaacaacttcatattatcggaggaggctgccagaatcgtttgctaaaccaacttactgcaaatgctttagacattccggtatatgcaggtccggtagaagcgactgctatcggcaatatcttagtgcaagcgaaagctcaaggtgaaatagatacttgggaagagctaaaagaaattatcataaacagtgtaaaacctcaggtatattatcctgaataacccgacaacccatgaaaaacaccaatcgttccattcttcataaagatggagttagttatatcctgccatttattttagtgacttcttgttttgccttatgggggttcgctaatgatattaccaatccaatggtaaaggccttctcgaaaatatttcgtatgagtgtcaccgacggggcattggtgcaggtcgctttttacggaggctactttgcaatggccttccctgctgcaatgtttattcgtaaatactcttataaagccggtatcctgctgggactggggctatatgctttgggtgccttgctgtttttcccggcaaagatgacaggcgattattaccctttcctgctcgcttattttattttgacgtgtggactctcgtttctggaaacaagtgctaacccttatatattatcgatgggtacggaggagacggcgacccgacgattgaatctggcgcagtcatttaatccaatgggatcattattgggtatgtatgtagccatgaactttattcaggcgcgtctgaatcccatggatacggtagaacgcagccaattgtctccgtctgagtttgaggtattgaaagagtcggatttgtccgtgttgattgccccttacctgattataggattagtgattcttgccatgctttttctgatacgtgccgttaaaatgcctaagaatggtgataagaatcataatattgattttataccaacgctaaagcgtatttttaaagttcatcattatagagaaggagtcatagcgcaattcttttatgtaggtgcacagattatgtgttggacttttgttatccaatatggaacacgcttgtttatgtcgcagggaatggaggagaaggctgctgaagtgctttcccaggaatataatataattgctatgattattttttgcataagccgtttcgtgtgtacatttattcttcgctacctgaatccggggatgcttctcaagattcttgcgattgcgggtggtgcttttacgttaggtgtgatttttttgcaaaacatatggggattgtattgtttagtagctgtttcggcttgtatgtcactaatgtttcccacgatttatggtattgctcttcgtggtttgggtgatgatgccaagtttggggctgccggtttgattatggcaattctgggaggttctatcttgccaccattacaggcttgtattattgaccaacatacattgttgggtatgcctgctgtaaacttgtcttttatacttccttttatctgtttcgtagtgattatcatttatggacatcgtacttgtgcacgtgtgaagaagataaaagcggcacgaaagtaatatggagaatcggatgcggcgtttgacgattcttctgagtaactgttttcttctgcttgtgtcattagtttcttgcgggaaagtgccattagcggaagaagcagtgttttctataccggtggatacggcattcatgaggcttcgtcaatgggagtggtattgtcagaaacgggctgacagttgcctgacagagaataattatcagggagctttatcttggctggattccgctcgtatccaagtggaacattacggacgtccttattatatattggcacgcggggacgtatattattccacccatcaatatgattctgcccgtcgttattttagtatggcagcccattccattcatccgcatattgctatcgaagcttggaggaaacttgcagaactggaacttatggaaggaaatgagaagcaagtgttctattctacgcagaaggcagatgcgcttttccgggtggagataggccatgtgcagagtgataacagtgaagctctatatcaggaagagaggttgaaaaacgagttaaaccaattgaagattgccaaacagaatcgggaaattgccatgttaactttgagcctttgtctgattatactgattgctttgtttattttctaccggcaaaataagataaagcgtgaaaaagagcgtctgcttcttgaagagaaagccaagttggagcaagagaaccaaatactgaaacaaactgaagagttaagtgctttgagagaaaaagaggcggttttgcgagagtctttgttccgtaaggtcgatgttttgcgtaaaataccctccctcaatgaagaagagcaggagagtggtgaacatcgcatagctttgtcggaaagagagtgggaggaaattcgtcagacggtggataatgcttatgatgggttttcacaacggttgcttgcacgctttcctttgttgaccttaaaagatatttatttctgttgtctggtgaagatcaatgtcagtataaaggacctttccgatatttattgtattagtcgtacctcggttagtaaaaagaaatttcgcatcaagcgagagaagcttggagcagaggattcggactctttagatgactttttgcgtggcttttagttctcggaaacttgtttgtccatgctgttttaagaggtggtttatgtaatatcttgatatgtagtatgatagcatgtccatttttgaagtgctttgtctatatccctttttgtttttcctgtacccgatggttaattttgcaatatcaaaactttaaaaatgtacatgatatgttgaatcgactgaactatttcattatgtcggcagggctgcttgttttagtagcatgttcgtctaattccgggaaacagatagaggtggcaaatacaccttttgtttacgatggattaaaagagtatccggtaaaagagttgaaactgtccgatctggcagttagtgattatgtggcattaaaagacaatgaaaattcattgttgggtaggttaccgacaaatccttgtatacaggtcactgaagaccggatttatattcaggatgaagagcagcaggctatatttatttttgaccgtcagggaaatccattattgcaaatgcgtcataaaggaggcggccctcaggaatgggcatctctgaactctttctatgtggacagtcctaacaaagaaattatagtgttggaccgcgctaaaaagtttatagtttatgatttgaatgggaaatttaaacgaagcttcccgacgcccggttgctcttggaagtttgctaacttgaatgataaggctgtattggtatattgtccttttacaaagcgtaataacggagaggcagtttgtatcctttctaaaaaagatggcaaaaagttgcatgtgtgtcctattacgatagataattttgtgtgggatagcgaggggcgtattggctatgaaccattgaagcctgcttatggtgggattttattttcagatttatcattgaaaggcgtgtattttattgatgctgaaacatatgaagtaaaacaggttattgatgaagtgacagaatataaatttgaaaatgcagagttcgttaagctacatccggcgatcgatgctaaagactatactttgtatactacgctcggtacgaaatggttgactccggatatgccaatggactattattatttcgataagaaggagcagaaaatgtatactttgaaaaatgaaaccggatgggctgttttaaaagatgtctgcaatgtacagagaacccgtacaacgaatactccaggtatcggcattggttattattggccttctactatgaaaggagagtcgatgcaagctgaaaaagagcagtttgaccctcgtttccgggcaataatggactctatacctgaagaaggtaaccctgtattacaaattatgaacttcaataaatgatgaagctgttccgcaagatattgattatttgtcttcttgggaagttaatggcttgttcgccattagcttccggggagataaatgatgtttgggggcataagcaagtggctacggttgaaatggcaggctctgatagcgtttgggtctgccacttgtctatgttgaaggatacggttactgtacctcttagtcattttgtcgaggaactggaaatggtcaaacttgataatcgggatgctgcattggtatctccttccaaaacaattattggcaaacagtatattttagtacataaaatggggcatgtccctttcaaactttttactaaaagcgggatctatttgagggatatcggttcctttggtcaaggtgcgggtgaatatggcttagcttacgatgcacagatggatgaggagaataaccggctttatgtgttatgttggcaggccgaccatatcttggtattcgatttacaaggaaatatacttcaaccgattcgattggcgcattggtcacctaaaggggtatttcatgtagaaacggaacgaggacgagtgcatgtttgtgctctttcttttaatcgtgactttgtaggtgataggcattcgcctatgatttggacgcaaagtttggatggcaagattataaaagaacttccggcagggtatttggccatgaatgattatggaaatgaaatcaaatctctgaataatgggacggtgatggacatcggtttctggtttggagggcaatatcgtaacgattcattatatcactataataaccacgagtttaggctcgttccacgttttacgcttgattatggaggacatgagttgaccccacacagcttcggagagttgccgaatcacttctggggagaaatatcatatcctgtaaggctaagtccacattcgtcaactaccactcctccggaatattatatggttgataaacatactttacgaggcgcttttgttgaaatatacaatgatttcttaggtggcattcctgctgactggttcttttcatctcatgacggatattatgtttggaatgttgaacctgcacgattgaagcaaatggttgaggagcgtttgtcttcaggtgagattatctcggattcggatcgaagaaagctgaccgaactgcttgggagtattaaagaaaacgataacaattatattttctatggtcgattgaaatgtagatagttcctgtttttttcttatcatttcttttttttctctaatattttgtagtcgaacagattatttatatctttgcacccgaaacggatgaaaggtggaggggcgattaagctcctttttttgttcttaatagttaatcaatgatagaaaaaagaactgtttgtcagattgttgaagagtggctggagggaaaagactattttctggtagaagtgaccgtcagccctgatgacaaaattgtggtcgaaattgaccatgcagaaggtgtttggattgaagactgtgtggagctgagtcgcttcattgagtcgaaactgaaccgtgaagaggaagattatgagctggaagtaggttctgccggaatcggacagccatttaaagtattgcaacagtactataaccacatcggcctggaggtggaagtactgactaaaggcggacgcaaactgagcggggtcttgaaagatgccgatgaagaaaagtttgttgtgaccgtacaaaagaaagtaaaacccgaaggagccaaacgtcctcagttggtagaagaggatgaaaccttcacctatgatgatataaaatatactaaatacttaattagttttaaataattatggccaagaaagaagaaacaatcagcttgattgatacattttcggaatttaaggaactgaagaatatcgatagaaccacgatggtaagcgtgcttgaagagtcgttccgtagtgtgatcgcgaaaatgtttggcactgatgaaaattacgacgtaattgtgaacccggataagggtgactttgaaatatggcgtaaccgtgaggtagtggcagacgaggatttgactaacccgaatatgcaaatttcgttgactgaagcacaaaaaatcgatgcttcttacgaagtgggtgaagaagtaaccgatgaagtgattttcgctaagttcggtcgccgtgctattttgaatcttcgtcagaccctggcttctaaaattcttgagcttgaaaaggacagtatttataataaatacattgataaagtaggtactatcatcaacgcagaagtataccagatctggaaaaaagagatgttgctgcttgacgatgaaggaaacgagttattgttgccgaaaacagagcagataccaagcgatttttatcgtaaaggagaaactgcccgtgcagtggtggcacgcgtggacaacaaaaacaacaatccgaagattatcctctcgcgtacttctccggttttcctgcagcgcttgttcgagatggaagtacctgaaataaacgatggcttgattaccatcaaaaagattgcccgtattcccggtgaacgtgctaagattgcggtagaatcttatgatgacagaattgatcccgtaggagcctgtgtaggtgtaaagggaagtcgtattcatggcatcgtacgtgaacttcgcaatgaaaacattgatgtgattaattatacatcaaatatttcattgtttatccagcgtgctttaagcccggccaaaatctcttctattcggttgaatgaagaagaacgtaaagctgaggtattcctgaaaccggaagaggtatcgttggctattggtaaaggcggtttgaatatcaaactggccagtatgttgactgagtacactatcgacgtgttccgtgagttggatgaaaacgcgcaggatgaagacatttatctggatgaattcagagatgaaatcgacggatgggtgattgatgctattaaagcaattggcattgatacggctaagtccgtattgactgcacctcgcgaaatgctgattgaaaaaacggatctggaagaagagacggtggacgaggtattacgcattttgaaatcggagtttgaagataatgaataatagatcaatgcgatgatgtgccgatatgccaataaacagaaagggcgtataggaattggcacattggcatattgaacgattatcaaattattctttctccattattctttaaattaaagtatgacgataaggttaaacaaagttacaagagatttaaatgtaggaatcgcgacggtagttgagttcttgcaaaagaaggggtataccgttgaggcaaacccgaatacgaaaattaccgaggagcagtatgcaatgctcgtgaaagagttcagcacagataagaaccttagacttgaatcggaacgtttcattcaggaacgtcaaaacaaagatcgcaacaaggcatctgtttctatcgatggttatgataaaaaagagccggagaaaactgttgctgatgatgtgattaagacggtcattccggaggatgtgcgtccgaagtttaaacctgtcggaaaaatagatttagataaactgaaccggagaactgaaaaagagccggtgaaagaagaaccgaaaccacaacctgtagtagctactgaagaaaagaaggtggcggaagaggttaagcctgttgtcaacgaagtggaaaaagaagaagtcgctacgactcctgttgcttcggaatcgaaaccggtgaaagaagaaccgaaaccggtggtggttgaaaagcctgcagaaacagagaagaaagtggttgaggaagtcaagaaagaagaacccaaagtcgtggtatctccagaaaaaacagagaagaaagaagagaaaccggtagcagaagcaccggctactccagtagagaaggaagaggagggcgtatttaagattcgtccgactgagtttgtatctaagattaatgttatcggacagattgacctggctgcattgaatcagtcgacccgtccgaagaaaaaatcgaaagaagaaaaacggaaagagcgtgaagaaaaggaaaaacttcgtcaggatcagaagaaacagatgaaggaagccatcatcaaggaaatccgtaaagaagataataaacaagctaaagtagccggtaaagaaaatcttgatcccaacggtaagaagaaacgtaaccgcatcaacaacaataaagaaaaagtagatgtgaacaacgttgcttctaactttgcgcaccccactccaaacagtgagcgtaccaataataaccgtggaggaaatcagcaaggtggcggcggacaaaacagaaaccgtaacaacaataataaagatcgctttaagaagcctgtagtgaagcaggaagtgagcgaagaagatgtagcaaagcaggtaaaagaaactttggctcgtctgacaagtaaaggtaagaacaaaggagccaaatatcgcaaggagaaacgtgatttggtatcgaaccgtatgcaggaactggaagatcaggagatggcagaaagcaaggtactgaaattgacagaattcgtgactgccaatgaattggccagtatgatgaatgtatctgttaatcaggttatcggaacttgtatgagtataggtatgatggtttctatcaaccagcgtctggatgcggaaacaatcaatcttgttgctgaagaattcggatttaagaccgaatatgtcagtgcggaggtagctcaggccattgttgaagaggaagatgctccggaagatctggaacaccgtgctccgattgttacagtaatgggtcacgtagaccacggtaaaacttcattgcttgactatatccgtaaggcaaatgtaattgcgggtgaagccggaggtatcacacagcatatcggtgcatatcacgttacattggaggacggacgtaagattacattccttgatactccgggtcacgaagcgtttactgcaatgcgtgcccgtggtgcgaaggtaacggatatcgcgattattatcgtagctgccgatgatgatgtaatgcctcaaactaaggaagctatcaatcatgctgcggctgcgggtgttcctatagtatttgctattaataagattgataaaccccatgctaatccggagaaaattaaagagacactggctcagatgaattatctcgtagaagagtgggggggtaaataccagtcgcaggatatttcggccaagaaaggtcttggagtacccgaactgatggagaaagtccttttggaggcagaaatgctcgatttgaaggcaaatccgaaccgcaatgctacgggttcaattattgaatcaactctggacaagggacgtggatatgttgctactgtattggtttccaatggtacgctgaaggtaggtgatattgtgcttgccggaacaagttacggccgtgtaaaggctatgttcaatgaacgtaatcaacgcgtaacacaagctggaccttcggaaccggtattgattctcggtttaaatggggctcctgccgcaggtgacacattccatgtgattgagactgatcaagaggcccgtgaaattgccaataagcgtgaacaattgcagcgtgaacagggattgcgtactcagaagctgttgactctcgatgaagtgggacgtcgtattgctttgggtaacttccaggaactgaacgtaattgtgaaaggtgatgtggacggctctatcgaagcattgagtgattcgttgatcaaattgtctaccgaacagattcaggttaatgtgatccacaaggctgtaggtcagatttcagaatcggatgtgacattggcagctgcttcagatgctattatcattggattccaggtgcgtccgtcagcttcagcgcgcaagtttgccgagcaggaaggagtagatatacgtttgtattctgtaatttacgctgctatcgaagaggtgaaggctgctatggaaggtatgcttgctccggaagtgaaagaggtggtgactgctactatcgaagtgcgtgaggtattccacattactaaggtgggtactgtggccggtgccgttgtgaaagaaggcaaggtgaaacgttcggataaggctcgtctgatccgtgatggtatcgtaatcttctcaggttctattaatgccttgaagcgctttaaagatgatgtgaaggaagtaggtacaaactttgaatgtggtatcagccttgtcaactacaacgatttgaaggtaggggatatgattgaaacttacgaagaagtagaagtgaagcaaactttataattctcacgaaactgaaaatatacggaggcacagagtgattacaactccgtgtctccgttttcgttttacatagaatgactaccatagatattatcatactgattgcccttggagccggtgttattatcggatttatgaaaggctttatccggcagcttgcctccatacttggattgattgtggggttgctggcagcaaaagctttgtatacttcactggctgtaaagctatgtcctacagtgacagattccatgactgtggcacagatattggcatttgtcattatttggatagctgtaccattaatctttacgttagtggcttcagtgttgacaaaggcgatgggggcagtttcgcttggctggctgaatcgtttgcttggagccggacttggagccttgaaatatcttttactggtgagtctggttgtctgtgtcattcaattcatagatacagatagccaattgattagtcaaacaaagaaggaggaatccttgttatattatcctatggaaaggtttgcgggaatgttctttcccgcagcaaaagaggttacacaacaatatatactcaaataaaaatgatgcaacaagaagaacccaataaatatgtaaaagaactcacgcaggagaagtacaaatatggcttcactacggaggtacatacagatatcatagagaagggactcaatgaagacgtagtgcggcttatctcgtctaaaaagaacgagccggactggttgttggaattccgtctgaaagcctatcgtcattggctgacactggagatgcctacctgggcacacttgcgtatacctgagattgactatcaggccatttcgtattatgccgaccctacaaagaagaaagaaggtccgaagagtatggatgaagttgatccggaactaataaagacattcaataaactgggtattcctttggaagagcaaatggcactgagcggtatggctgtggatgcagtgatggattcagtatctgtgaaaacgacctttaaggaaacactgatggagaaaggtattatcttttgttcgttcagtgaagcagtgcgtgaacatcccgacctggtgaagaagtatcttggatctgtagtaggttatcgggataacttttttgctgcattaaattccgcggtattttcagacggttctttcgtttatattcctaaaggggtacgttgtccgatggaactttccacatacttccgtatcaacgcagccaataccgggcagttcgaacgtacattaatcgtagcagatgacgatagctatgtttcctatctggaaggttgtaccgcaccaatgcgggacgagaatcaattacatgccgctattgtcgaaattgtggtacacgatcgtgcagaagtaaaatacagtaccgttcagaattggtatccgggtgatgccgaaggtaaaggtggagtatacaattttgtgacgaaacgtggtaattgtaaaggagtcgatagcaaactctcgtggactcaggttgagacgggatcagccattacctggaaatacccttcttgcattctctcaggtgataattctaccgctgaattttattcggtagcagtgacaaacaattaccaacaggcagatacaggaactaaaatgattcatttaggtaagaatacccgtagtacgattgtcagtaaaggtatatctgccggaaaaagtgagaactcttaccgtgggctggttcgtgtagccgaaaaggcggataatgcccgtaattatagccagtgtgattcattgttgctgggtgataagtgtggtgcacatactttcccctacatggatatccataacgaaacagcagttgttgaacatgaagcaactaccagtaagattagtgaagatcagatattctattgtaatcagcgtggcatttccactgaagatgccattgggctgattgtaaacggctatgcaaaggaggtacttaataaacttccgatggaatttgctgtagaagctcagaagttgcttacgatctctcttgaaggtagtgtcggataatggggtgcaaacgaattggttggttattgatattcctgctttatgtaggtatagcgtttgcacagaatctggatgatcaggagagaagatgggcaatcagtggctcttggggaggagactggccgatagtaacaaagaacacactttcgggaaaagctgtttctacaggccatatacatactttattgctggagtattatattccttatacccgtttctctttgaagggcggttatacaggtgaagagataaaactgaatcccggtatttctgcctcactgagcaatctggaagtgggagggcgatactatttcctgccacaacgttttgtgattcagccttacgggggactctccacagcatggaatctgtctccacgtcgacaatacggcataaccagtggcagttactacgatccttcaagacaggaatttcgtaaagactacgattgccgatatcaggtaaaagaaccgctattcactatctctccggtgataggggccgatatatattttctttcgtgtcttgctttcaccctggagtataatttccggatgggcattgccggaagaatgaatggagaagtagagaagactaattcccgggggaccgggatagtgcgtagtagcgggatgcgtcagacattaagcgtaggagtgaaagtgaattttccttttactattacgcagacagatggcaattccatactgcaattgttggacgaagttatttttggagaagaatagataatgaaataattgataagatcatgttagagataaaagacctgcatgccagcattaacggcaaagagatattgaaaggcatcaacttgacggtgaatccgggcgaagtacatgccattatgggacccaatggttcaggtaagagtacgctttcttctgttctggtaggtaatcctgcttttgaagtgacgaaagggagtattacattctacggtaagaaccttttggaattaagtcctgaagaccgtagccacgaaggtatcttccttagttttcagtatccggtagagattccgggtgtgagcatggttaactttatgcgtgctgctgtcaatgaacagcgtaaatacaaaggtttgcctgctctgacagccagtgagttcctgaagctgatgcgtgaaaagcgtgcagtagttgagttggataacaaattggcaaaccgctcggtaaatgaaggcttctcgggtggagagaaaaaacgtaacgagattttccagatggctatgctcgaaccccgtcttagcattctggacgagacggactccggactcgatatcgatgcgcttcgtattgtagccgaaggagtaaacaaattgaagacacccgataccagttgtattgtcatcactcactaccagcgtttgttggattacataaagccggatatcgtacatgtgctctataagggacgtattgtgaagacagcaggtccggagctcgctcttgagctggaagaaaaaggatacgattggattaagaaggaattaggagaatgagtgtgattatgaatgtagaacagcaatacatagatctttttgctcagtgtgaagcgatgatctgtcgtcatagtgccgagcccatgaatgctccccgggcggcagcttttgctgatttcgagcgtcagggatttcctacgcggaagcaggaaaagtacaaatacacggatgtcagtaaattcttcgagccggattacggcttgaacctgaatcgtctacccattccggtgaatccttatgaggtgtttaaatgcgatgttccgaatatgagtacctcattgttttttgtggtgaacgatgcattctacaatcaggcacttcctaagtccggattacctgagggagttattttcggcggtctgagagaaatggctgagcaacatccggaacttgtaaaaaagtattatggtaagttggcagatacttcgaaggatgcagtaacggcctttaatacagcttttactcaagacggagtactgatgtatgtcccgaagaatgtggttgttgataaacccatccagttggttaatatacttcgtgcagatgtcaatttcatggtaaaccgacgtgtgctgattatccttgaagagggagctcaggcccgtttgctggtttgtgatcatgccatggataatgtgaactttctggcaacgcaagtcattgaagtgtttgcggaagaaaattctgttttcgatctttacgaactggaagagacccataccagcacagtgcgtttcagcaatctgtatgtgaagcagggagcgaatagcaatgtactgctcaatgggatgacacttcacaacgggacaacccgtaatacgacagaggttacccttgccggtgaaggtgccgagattaatctttgtggcatggccattgccgataagaaccaacatgtggacaataatacttctatagatcatgctgtgccgaattgtaccagtaatgagttattcaagtatgtacttgatgatcagtcagtgggtgcctttgccggattggtacttgtacgtccggatgcacaacataccagttctcagcagacaaaccgtaacctctgtgccactcgtgatgcccgtatgtatactcagccacaattggagatatatgccgacgatgtaaaatgctcccatggagctacagtaggtcaattggacgaaaatgctctcttctacatgcgtgctcgtggtattgcagagaaggaagcccgtttgctgttgatgtttgcttttgtcaacgaggtgattgataccattcgtttggaggcattaaaagatcgcctgcatttgttggttgaaaaacgtttccgtggtgaactgaataagtgccaggggtgttctatttgcaaataatcagtgataaaatgaatattcagaagatacgtgaagactttcccatactcggccgtacggtatatggcaagcctttggtttatttagataacggagcgactactcagaagccgcgcttggtgattgactcgattgtagatgaatattactcggtcaatgcgaatgtacaccgtggggttcatttcctgtctcaacaggcaacagaactgcatgaggcctcacgtgagactgtgcgtcagttcattaatgcacgtagtactcgtgaagtcattttcactcgcggaactacagagagcattaatttaattgtttccagttttggtgaagagttcatgcaagagggggatgaagtgattatttcagtgatggaacaccacagtaacatcgtaccttggcagttgctggcagcccgtaaagggattgcgattaaagtcattccgatgaatgataaaggtgagctgttacttgatgaatatgaaaagcttttttctgagcgtactaagatcgtcagtgtaactcaagtatccaatgtattgggaacaatcaatccggtaaaagagatgattgccacagcacatgcccatggagtacctgtcatgatagacggtgcccagtccattcctcatatgaaggtggatatacaggaactggatgctgatttttttgttttttcgggtcataaggtatatggaccgaccggaatcggtgtcctgtacggaaaggaagattggcttgagcgtcttccgccttatcagggtgggggagagatgattcagtccgtttcttttgagaaaaccgtttttggtgaattgccttttaagtttgaggctggaactcccgattatattgctactaccggacttgccaaggctttggattatgtcacaggcattggtttagatcatatagctgaccacgaacaagagcttaccatctatactatgcagcgattgaaagagatcccgggtatgcgtatctttggtgaggcagcacataaaagtagcgtagtttctttcttggtaggtgacatacatcatctggatatggggactctgcttgatcggctgggtattgccgttcgtaccggtcatcattgtgcagaaccattaatgcaccgtttgggtattgaaggtacagttcgtgcatcttttgctatgtacaatacaaaagaagaaattgatgaccttgtagccggcatcgagcgggttagtaagatgttctaagccagtgtgtgtattctgacaaatattaaagtgtcgtgaaagtaatgggctttcacgacactttttttataatatccgagtgttgaaattatattgataaaaggcgagtcttcgagtatatcattagatgttaagtggataaagtttcatttccgaatgtagcttttgagaatatacaaataataaaaatagccggttccttgtaacttttcgcctctttttgcgtctaataataatataaaccttataaacagaaaagaatatgttattagcaaccactccgataatcgaaggaaaacgaataaccacttattatggtattgtgtcaggagaaaccattataggtgccaatgttttccgtgacttttttgccagtattcgtgatatagtaggcggacgttccggttcgtatgaggaagtgcttcgtgaggcaaaggatactgctctgaaagaaatgtctgagcaggctcgccaaatgggtgctaacgctgtaattggtgttgatttggattatgaaaccgttggaggaagtggtagtatgctgatggtgactgcaagtggaacagccgtatttttggaatgatagagaaatcataaaagctacgtttagaaatgcagatgttccgaactttcagaacatctgcattgattatgtcttttacctattgttaacgactcttactaatttccattttatcaatatcgggtgcccatccgttagagttatataggcgtattgtattataacccttatgaagttttactttgacagttgttattgctgcttggtcccatgctccggagcaaaggccggattgcttatattctgattcattgacagcaatttgtatatcacgtttgtctcctgaaaaataagttatcttaagttggtactctcctcctttactcacatatacctttctgaattcagcccagttagatggtgagttcccaagtcttttcattatataatctccagatgctcctgctttatatgcacaatgagccatttgtttgttgtctggtaaatactcttgcatgaaagcatattcagcctcataacatattcggtcgtggcgtttactaccttcaagtcttattaaggccgttccgtgtgcaggaactaaggtttcataatattcggtgaatgttcctgtttcttgatgattccacaagtctctgacttgtaccttgcctgataaatatagtttgtcgaagtcaactcttattttttttattacattacttctattatataaagcgacagcgcgtagcttgccttcgcgtttttgaatagtttttgataggattaaatagtcttttccccgttctataacttcagcttgcatccccaaggagtcttgatttaatgcgattacctcttgattggtaatgatcgataatgttttctctggaattgtccgaagatcgcatcctatcattaatggagaggacatgatagcccatattccgaaatgggttttttcctcgtcttcactgagacctcgtccgacttcaagcatatccatgtcattataatgtcccagacttacgtaaggtgacaggtagagattcttttcaatgatttggtcaatcgtcttaaatcgaggattaatgtcagtgtggatacgccaggaacttgctaatcgggtagcccaggtaccagggaattgccatcggcatatattatatcggacatcagttcgtcctgtccggttgatcgctttgtagatgtctgtatagcgttgctgctcactttgtccggtggcttcaccaccacaccagtcaatcttaataaaatcatatccccaatcttggaaaaaggtcttacagtctatatcatcatgttgccagagtcctactccaacgccaagtgtatctgcatcatagatagagccgcaagtattactacctgcgtccgaatatatacctgcttttaatcccttagaatggatatagtcagctagtgctttcattccattcgggaatttctttttattggtaaacaggtaaccatttgagtcccgtcctccgaaatatccgtcatcaatgttcacatatttgtatccggcatccttcagaccgcgggtaaccatagcatcagctgtttcttgaatcagtttctcgttgatatgaactcggaatgtgttccatgagctccatcccatcatgggagtatttgtgttttgtgccgtgacagtcgtgaaaaaacttgcccataacagaaggcaacagtaagtaacttttttttttctcataaggcgttgttattataagataaatagcctgtatattcctgttaattaggtatatacaggctaatttgtgtcattcggatggatgaattaccacccagggttttgaaccaaattcgaatttacatttagatagtcctgtttgatcggactcagatattgttcgtctctgaagataaaaggttgagcatccaaacgtgcattcttatagtattcttcattagttgtaccgtaagagttcaagccgatcatgccattctccataccgctccattctttctgggcgattagccagcgacgataatcatatgacatatgtccttcgaacattagttctactgttctttcacggtgtattgctttgcggagtttgtcaccgattggaagccctttgtatgaaacttctatgttaggaataccacctctctggcgaatcagattgaagtacgtcaatgcatctccttccagtgtaccattgtattcaaagtaagcttctgcataatccaaatacaattctcctaaacggataataggaaagggaaaagctactaaagagttactggtaccacttacgaatgtttcaggatgagccagttttgcaatagcatatgatccgtataactggtcacttcctgcatcgcgtgttccattctgttctttgaagcgcattttgagattgattgtatcaccgttgattaaatagtcgccacggttaaagccaatagacccatagaaacgaggttcacgattgcgatgaatctgagcaacagaatcgccttcggctacattgaaacggtgtgtataatcaaattcaggatcttcatccatcgggagtccgttcttagtcagatacatatcagcgctgaaagctgttgctcctaaagccccgtaaggagctcccgaagaggtgctgatacctttggggatcacatgtgtctgaatggagtttccgtcagcccatgtctctttccaaccactatacccccaaatcagttctttattccaggcgtcgactacaagattgcgtgcattggcgatggcttgattgaatgctggtaaattaccttttttggtgtatttataaagttccgctccggcttgatgtgccatgtcgatagcctttttgcattcgtccatagctattttccatttatttttgtcataggccaggttcataagcaactgtccgtccttgttcttgaaattgtcatacatttctgcatttccattgaattgtggactggcggcatacaagtacattcttgcttttagtgcttgggcaatcacttttgtagcgcggccgtaattagaggcttttactgtcatgggcaaatcgacagaagcattgtcaaacatttgtgcaatccgatttacacattcatcatagggcacacgtggcttaaatagctcttctttgggagcattaagtgggattgcctcgtcaagtatgacgataggtccgtagttctgtaataacaggtagtgataataagctattagaaatttcacttctcctttccaaagtactttcttggctgcaaggtcagcttctgaaatttgagatggctttacagcatcaatattatccaggaatgtatagcattggcggataccgttatatgagctttgccaaacgtcgatgactgggtcggccgaattatacaatccttgctgcatcttcataaaggtgaaccatgtggtagtccagtgtgctgatccgacagtttcaggagttgtacaccaactgaaattttggcggaagttcagataattgggtatgaaagagtagcatgcgaaaacaaaattttcagcagtctgttcgttcttaaacgcatcggctaagataggagtgtcatctggtacaatatccagataatcacaagagtgcaaactagttccgattagtaaagctacgattatattttttagtttcataattattcagatttttaaaaagtgaactgtaaaccgatggaacccatgatttgagtcggatattttaatccgtttgaggtgtagagttccggatcccataatttaaatttagagaatgtcagtagattctgaccactgatataagcacgtaagaatttgtaagagtatcctaattctacatttttaagtcgaatatacgaaccgtctctcaaccagtaagtagagttgggattgttattgttgttctttccgtttgtcagtcttggatacatcgcttcggagttcggatttgcttctgtccaacgattgtcggccacaaactgcataactccgtaagattctcctccaaaaggatggatgtcgcttaacatgatacttcttttgcctacaccttggaagaagatagaagcatcccatttcttatattggatactgactccgagaccatagctgatctgaggtaattctgggtttccgatataggtttggtcatttccatcgatttttccgtcattattgagatccgcatatttgatatctccgggttgtaccactcctgtcaatatttgtttgggactgttgtcaatttcttcttgatctttgaaaagccctaatgcaatgtaacctttatactggttcagtggacgccctacttgggacatatatgagaattcataatctggttcatcaatttctacatattggttttttgcgtaagtgaaggtacctttggctgagatcatgaaatctttgttgacagcgtgattgtagtccaatgacatatcaacaccttggttacgtacttttcctaaattaccataaggacggagatctccggttataccactttccgcagggattgtattacgtctaaggaagatatctttgcggtcttctctaaaaaaatctacgttgaggcttaatttgttgaataaccccagatcgaatccaacattatatttctttccgatttcccatgtcactttttctgctccgtaagtagtaatagtagctccattcgaagacgtttgccattggtcaccaaatacgaatccggctccactcaagtctactttcgtgaggtatgggaaacggttggaaccaatatctgcattacctaccaatccataagaagcacgaatttttaagttggaaatgactttagtcaatggttcaaagaattgttcgttagaaataagatatccgacagcaagtgaggggaagaatccgtaacggctccctttttcgaagttttcactaccgttgtatccgaaattgaactcagccaggtaacgtccgtcgtaagcataggttaagcgacccgctaaaccttgattgcgttttggcaatgtattgtaatagttgttgtctggattgtttaggttgtattcacgttgaagatacactaacattgctccgacgtcatgtttatcatcaaatgtatgttgataatttaatgtagcctgtaggttcattaaacgatctcctgtggttgatgtagatgtttcaagtgccgtacgccctttactgatagaattataatcatagatataacttccgtcttcttgctgctgaggattctgcaattcgtagaagtagggtgagaaggagcgatttacagtggtctttgaccagttcttaaaagataccagtgctttgaaattcaatcctttagttatgaaatcaagcttttgctccagttcgaaagcggtattaatgctgtatgcgctttgtttagaacttccttgaaccatacttgcataagggttacgataaatactgaatcctccggctccgataggaccgcctgatttatttccaaatatggtatggtcttcattgttaatattaggatatacaggtgcaaaatacatggaaggtgcttccattacatacttatacaggtcgtccatacttgttgacggaccattatagttgacaatctgtgagtttattctcacatttactttagtgcttgaagttagccatgctcctacattgctttggaatgagtagcgaagattctgtatgttattgtcgaatgtgttattagggtcttttttcagcataccgttatcgttattgatagaagcgctgatgaaataatctactttctttgtaccacccattacattcagattggccgattggttcatagaataatctttgaacatatagtcgaaccagtcaacgttgggatatacatattgatttctgttttcaagtgttccttgtatcttatcagcggagaaagcaggtgtcccatccgggttacgtgtcaggatggcctcatttctcagttgcatagctgtcacagcatcggctaacttgagtgtacgtgtcggtgcagtgaatgtattatcgatgcgtacattgatacgtgctctttcgaggtctttaccggatcgggtagtgatcagaattacgccattggcaccacgggcaccgtaaagggctgtagccgaagcatcttttagtatcgagaagttttcgatagcttcagaaggaatagcattcatgtcgcctgctgaaacttctacaccgtcgataaaaatcaacggatcagttgttccactgaaagttgcggcaccacgtatccagaagtttgctccgtctgcacccggttcacccgtgcgctgcatggaaatgacacctgcgatacgtccggcgaatgatgtactaaggttactggagggtactcgaagctctgctggtttgatggattgtacggcacctactacactggctttcttctgtgtaccgaagcccaccactactacttcttctaatgcctgtgcatcgggagttagtttgaaaacaactatttttttcccttttagctgaatttcaacgggagtatatccgataaaagaggcaatcaaagtgctgttttcgggagccatcagtgtaaagtttccttcaatgttggttacagctcccagcgagttattgccttttattgtaacattggctcccggaactccttcaccgttttcatcaagaacctggccagtgatttttgtttttttttcctgttgcggtgtttcggtcggtgcctttgtgattgtaatctgccgatcgttgatggtatacttcaatccgacctcctttgacaggatattcaaaatagattctacgttctgcttatctatcgaaaccgatactttcttttgtagtatcggtaataggtccttggagtacaaaacgacaaattcactgttcttttcgacgtattccagcacttcttttacagttttatcggctgcgtggagtgtgaaaacagtttgttgagcataagtctttgctgcatgaaccggagtagtgatactcggtataagtaaaaaaatactaattaataaaaaaaaggacgtaatcctccctgccttatgacaaggaattgctttctttttcatacatttacattgattttagttaatcattaaagtttgtgatttaataaaaagtcattagagtcggataatatgggcgtattatccgattttctttttttatctgttttctttctacataatggtgtgtttttttaaggttaaacattggttacttaaaacttgtattattctatatagattacattgtttttcattgtatattcagcaggtaaaatagacagaatcgacttcattacctgatttaaatcatcatttaaatagagcttaccaaacatttgctcgttttctacagcagcatcgcatcggatattctgaccataataatcttgtaaccgttgcaaaacttgctttagactttctccttgtagagtccatattccgtcaatccagctgatataatcacgggcatctactttcgctttacctgttatgcctgcctggctgagttctaccttttcattaggcgccatcttgatatggcggttctgctgatctttcacatttaccgaaccttctaccagtacaacagtagccttttcttgacctttataggctgatatgttgaaagatgtgcccaatacgcttacctcaaatccggaggtattcacaataaaaggtttcgaagcatcatgggctactttcagatatacttctccttccacataaatttctctgtactttccttcaaatgtacgagggtaaatgactttacttccggagttaatccatatcttgctgttatcggccaaaacaatttgtgaacgtttgcccttagggacgataatctggttgtatgcctctttgctgtcatcctctgtaagtttattggagttgacttgtacttgtccggtagcagaataagtgacttgggcattattatccaattctattttcttctggtccgaaacaaccagtgtaacctcttttatatcttgaggtatttctgtttgcaggctttgcgctatcttatttaagtcgtgcctttcttcatcattcatcaaaagaaagcaagtaatccctattaacatagctacagatgcagctgccaatgaatacctcatgatgctgaaccattgtatggacttgccgcttttcttgatgtggctgacagatgtactgtcggcatttattttgttttgtaccttttcccatatatccgtttcctctgtttctgggggaaaacattggttccaaagaaagtcgagtttatcatattcggcttgttcctccggagatgcgaatgatttcttctccggatgatcaccatccttattcaggaaggaagcaaataatttaaacttattctttctcattactttaatagggttacataaataaagacgcaacttctttaagaatctcctattccaattctatttttttttaaattattttctgatttattttttcaggccgctcgagatgatctctaatgctttggcaacgtgtgcattaatggtctttacagatatattcagcatatcggctatttctttatagggtaggcgttctatcttggcaagagcgaagactaccttgcatttgggaggaagtgtttgaatgaggctgttgatttgggctatctcttccttgctgatcatctgttcgtcgggagtttgcagatttccgattatctggaagctgtctatttcttcccaggaagttatttcatttgaattttccgcttttcgcagatacgagatggctttgttgtgagttaaagtaagcaaccaggcttttatattcttgatttcttctatttcttcccggtgcctccatacatccagaaagacatcgctgactacttcttcggcagtttctttggttcgtacgaaacactgtgcatagtagaacaagtctttcgagtagctattcacaaaatgacggaaagaagcttcttctcctttctttatcttgctgatatattcgatgtcgttgttcatatatagagtaatggttgctatatgtgtgctgcaaaaatataaaatataaacttcttttcttaatatttattacattctttcgttcttcaatttaataatatgtggtatttaaaggttagattaacttttcctgcttttatttgcatgttttgtgttaaccataaatgaaaggcgggatactgtcaaagtgccccgccttttgcatctgtgttttgtgggttgatagtaataagtttattctgccaccagttctattacccggctatgggtctgtgaagtagtaaatgcattcaatcctattttcatcagatagtcaccggagaagattttttcattacccggtagattcgatttccggcccggcattagattaatttctttcacccggtacatttttccggcatcaagtccccggagcttaatcgggagcagtttctcgccaaagcggggatggatatcatatgcgaagagaacagctttcgaagcatccggtgcggcatacataatcgccatgtgattgctttcatatggagagatgaggcggtattgatcaccatccagtatgacaggcttcaggcgcttataatttgccacggcttcttggcaataagtcagttcgtccgctttcatatctttcaggccgatgtcgaatcccaatttacacatgctggcaacatcggtacggaactttacactcgtcctgctgttccaacttgtaacatgggcacacatggctttggaagggaagaattgtgaaaaaccccactggatgaacaaacgctctatcggatcggtattgtccgaacaccaaaactctgtgaagtatttcagtgcttcgtagtcgcaacgtgcaccaccgccggaacatagcatcatcgggacattggggtatttttctttgacccgtttcaatacattatatataccgcgtacatgattgatatagagttgtccttgtttgtctttcagatagggagaatagatattggtgatggggctgttgcaatcccacttaaagaaagctacatcagggttttccgtcataatcttatcgactacgccgaatacgaaatcctgtactttggggttgctcaggtcgagtaccaattgattgcggtaataataagtttcacggttcggataatggattgcccagtcgggatgtgcttcgaacagatcactttgaggattcaccatctccggttctatccagataccgaatttgacaccggcttctttcgctttctctactaatgcagggatacctccgggaagtttgcttttcattgcttcccaatcgcccaggccggcatgatcgtcgttgcgtggatgtttattcccaaaccagccatcgtcgagtagaaacatatctacacccagatgtttggcttctttcatcaatttacccaataactcttcatcgaaagtgaaataagtgttctcccaattattgaggagagtcatccggtctccctggccatctttcagttggtagttgcgtgcccagttgtgtaaattgcggctggcttctcccgtaccgttgttactcagggtaaagataaattccggggtagtgaatatttcgtttgcttttaattgataatccgaagcatacgggttgatggcagggattacccgcaagttcccctcgttgtctacctcaaaagtaaactggaagttgcctgtccagccaatggtacccaacattacttgtccctgatgttcttgtgcaggctgttccagtccgagttcgaagaaaggttgcatgtgcatggctgcgcggcttcctaattttgtatcgagaatttttttgcccggttgcaattgttgtgtactcatctgtacctctttggcccagtcactgctgaattcggtgagataatatttttggtttgcgaaataaagcatcgttgaagcataacgccatagagtgaccggtttcttctgttgatgcgtgatctcactccatgttttgattacattttgtttaggataagatacatagtgcaacgtcacatctaccggatactggtcgtctttcatccggatgatggtctctgtcccgccttctactgttttctgttccgaggacacataacgcaggatggtactggggttaccgtcgttgtttgtaatggctacagccggttcgaaatagtcttccccaccggatcccggatatacttcccatccgcgggatcgccctgaaaggtggctcaggtcccggtcgtttaatagtttgtcacccagataagcctgatataggcgtccgttcggggcgacctctaaaataaggtctgtccgttctgtcgagatgcgaatctgcttcgattcttgtgcacttacatggaggcaggctgtaagaaccaatagtgttgcaagtaattttttcatggtattattattgatgttataaaatatgcattgtgcatgcaaagtaaaggaaacttcgctatattcacaaatgaaacgaaaggaaacaaacgggaatccatacttctgtttgttaagtggttctccggcaagtagtgcaactttcagggcagattcctttattgcgggaattatcgttccgctactttgtttttgcataacataaaattgtgtaattttggagagctaaaaataaaggaggatgaaaacaagtctgaaactaattccgggagctatgcttgtgcttctttttctgattaccgcctgcaatctctacaggcgaccgattcccgatgagatgataggagagcataggattcaccgtgctgacggcttcatgacccaggactatcgtttagcgattaatccggtcaatgattcggtatatgatattaagttgtgggagaagaagagctcctcaagaaagccggagcagatatattatgatggattacgtttccattaccgggatactgtgcatatttccacgaaacgcgtcacgagcggtacggaaacttatcgggtaaataaaagacgggtaacacgagataagaatcctcgtacgtggtatactattcggctgagcagtggcggatttgtaatgtctgattcattgatagagcggcaaggcgtttccgacgagcaacatcggaagtggctttacaaacagtatggcaaattgactttccgcgaagggaaaattgtttttctgaacagtcgttgtccggcgttttatttaaagaagcaggagagatgaagcgttttgtatctgctcccatttttcggggctggcagaagcaaaaggcaaaaatatttggttatctcgtttagattcaatacttttaggatttcgttaaacctttaaatattgtacgtctatggatagcatccttttctggcttgttccgcttgcctctgttctggctctctgttttgcgctctattttcataagcaaatgatgaaagagagcgaaggtactccgcaaatgattaagattgccgctgctgtacgtcggggcgctatgtcttatctgaagcaacagtataagattgttggctgggtctttctgggactcgtgattctgttctctgtaatggcttatggttttcaggtacagaatgcctgggtaccgatagcctttctgaccgggggctttttctccggactttcgggttttctgggaatgaaaactgccacttatgcttcggcacgtactgctaacgctgcgcgtacgtcactgaatgccggacttaggattgccttccgaagtggggctgtgatgggactggtggtagtagggttggggttgctcgacatctctttctggtatttgttgcttaactgggcgattcccgctgatgcactgacacctacccataaactctgtatcattaccactacgatgctcactttcggtatgggtgccagtacacaggcgctctttgcccgtgtaggcgggggaatttatacaaaggccgctgatgtgggagccgatcttgtaggtaaagttgaggccggcattccggaagacgatccgcgtaatcctgctaccattgccgataatgtaggtgataatgtaggcgatgtggcaggtatgggtgccgacttgtatgaatcttattgtggttctattctggcaacggctgctttgggtgctgccgcctttattcatacgggtgatacggtgatgcagtttaaagctgtgattgccccgatgctgattgctgctatcggtatcattctttccattatcggtattttctctgtccgcaccaaggagaatgccaccatgaaggatctgcttggttcgttggcttggggaacaaatctgagctcggctttgattgtagtggctacttttttcatcctatggctcttgcgactggacaactggatgtggatttcgtgcgcggtagttgtagggctggttgtgggtattgtcatcggtcgttcgacggaatattatacttctcaatcctatcgtcctactcagaagttgagtgaaagcggtaaaaccggtcccgccacagttattatttcaggtatcgggcttggtatgttatctacggctattccggtggttgcggtggtgatcggcatcattgcctcctatttgctggcttccggtttcgacttcgacaatgtaggaatggggctttatggtatcggtatcgctgctgtcggtatgctttctacattgggtatcacgcttgctacggatgcttatggcccgatagcagataatgccggtggcaatgcagaaatgtccgctttgggtaaagaggtccgtaaacgtaccgatgcgctcgattcgctgggaaatacaacggcggctaccggaaaagggtttgccattggttcggcagctctgacaggattggcattgctggcatcttatatcgaggagatccgtatcggactgacccgtttgggtaatctggaactgaccttcccgaatggagataccattactacggctaatgccacatttgtagacttcatgaattactatgaagtaaacctgatgaatccgaaagtactttccggtatgttcctcggttcgatgatggcattcctgttttgtggactgactatgaatgcagtcggtcgtgcggccggacacatggtagatgaagtacgacgtcagttccgcgagatgaaaggtatcctgaccggagagaccgaaccggattacgagcgttgcgtcgctatctctacgaaaggggcacaacgtgaaatggtggttccttctctgattgccatcgttgcgccgattcttaccgggctgatatttggtgtccccggtgtattaggcttgctgattggcggattgagcagtggatttgtacttgccattttcatggccaatgccggcggagcatgggataatgcgaagaaatatgtggaagaagggaactttggcggtaaaggcagcgaggtacacaaagctacagtggtgggtgatactgtcggtgatccgtttaaagatacgtccggtccgagcctgaatatcctgattaaactgatgagcatggttgctatcgtcatggcgggattgactgttgcctggagcctgttctgagttctaaaaaagaccgttttatccttctcctacagaaaatgtgtttcgatcttccatcttccaccttttaatgaccaattgcttgtattattgtgtgttaacaaggtggaagatgcgtttttaaggccgtttatcttccacctctatcttccatcttccaccctctttcagggaggttggtttaatgttaaatatctgggagttagatagatgaaactgcttttctatggataaatgtcagtaatagcattttgctttccttcatacctttagcgattatggtttgaagtttatcccggcccttgtacccgggctggtgagcccgcatacctgtgcccatgggcccgcatacccgggcttatgagcccgggtatgcgggccgggataaagttatggtaacagatgcttgttctcttattcttaatgtgttatagatgctatgacggatgcttgccttcttcttaatctttttgcagaaaaggtagatgctcctattccggatagtaagatgagattcggtttgttctgttgttcatttccgtttaattgattacatttgccatgttaaataaaagaaacgatgctcttaccctggttaaacgaagaactgatagaagccggttgtgatgaagccggacgtggttgtctggcgggtgcggtttatgccgctgctgtgatcctgcccaaagattttgagaacgagttgttgaatgactccaagcagttgtccgagaaacaacgttatgctttgcgcgaagtgattgaacgggaagccatcgcttgggcagtcggcattgtttcacccgaagagattgataagataaacatcctgaatgcttcgtttcttgccatgcaccgggcagtagatgggctaaaaacccgtcctcagcatctgctgatcgatggaaaccgttttaggaaatatcccgatattccctacaccaccgtcgtaaagggagacggcaagtatctttcgatagctgccgcctctattcttgcaaaaacgtatcgtgacgactatatgaatgggctgcatcaggaatttccatgttacggctgggaccataacaaggggtatccgacgaaaaaacaccgtgcggctattgccgaaaacggtgttactccttatcatcgtatgaccttcaacctgttaggcgatggacagctggagttgtttcctaaatagacgattctttatcagaaccactttattttcctgaagataacaaaagaaagagtcgacaggagtacggatatcagaataatcagcatgaaggcatgaggcatctcttccaggtgtatatccacattcatgccataaaaactggctattaacgtggggatcatcaatgtgatggaaaggcttgtcatgcgtttcatgatggcgttcacattgtttgaaatgatagatgcaaaggcatccatcgtccctgtgaggatatcgctgtaaatgttgaccgtattgaacgcctgcttcagttcaatgataacgtcttccaccaactcttcatccagaaagtcggtatcttgaaagatggttttcagtttaccgatcatcacttcgttgccgcggatggaggtgttgaagtagaccagtgtcttctgcaacttcatcaagcgtagcaaatcttcgttacggatgctgcgttccaattccttttcggcagcggtgatgtcaatatttatctgtttcaggtacttcaggaaccagactgccgaggaataaatcaggcggaaaatcagatcgagtttgttgcgcacttcgattcctttccggcgggtatgctcgatgaaatccggaatcatatccgtctgatggtaacataccgaaacaatgatttcattgttggtgatgatgccgatggggacggtgatgtaggggaggctgctttgagtgttctgtaccggtatgcgcagaatggtcagcagccagttaccttcggtttccgttcgcgggcgttcatcggtatcggctatatcgtttaaaaaagattcagggactttcagcgtttcggtcaggaatttaaaatcactgctgtccgggcacactacgttgacccagctgttcggaagccattgtgctttttccacaaagccggcttcacaataaagatatgttctcatcttattgcctcctttcgtttgttgatgtccgagcagaggcattaccgcagaatgactctgttcgtgttagttaatactgttgcacgttcgcgggtttgaatcgtccatattctgttttttatttttaaagcggcgcaaaagtaaggaaatcatttcaaatctaccgcattttttcttcctttttgtctgatagggagatagcttaacatagattaaacgtgttcgtaattaacttttttgtacctttgcacccgaaaatcagaacgacaattaaattttagaatattatgagtaagaaagcccttttaatgattcttgatggttggggattaggcgaccacgggaaagatgacgtaatcttcaacactgctactccgtactgggattatctgatggagacctatcctcactctcagttgcaggccagcggtgaaaacgtaggtttgcccgacggacagatgggtaactcagaagtgggtcacctcaatatcggtgcaggacgtgtagtttatcaggatttggtaaagatcaacctctcttgccgtgataacagcatcctgaagaatccggaaatcgtttcagctttctcttatgcaaaagaaaatggaaagaatatccatttcatgggattgacttcagatggcggtgtacacagttctctggatcacctgttcaaactttgtgatattgctaaagaatataatattgagaatactttcgttcattgctttatggacggacgtgacacagacccgaaaagcggtaaaggctttatcgaacagttggaagcacactgtgccaagtctaccggtaaagtagcttctattatcggacgttactatgccatggaccgtgataaacgttgggaacgtgtgaaagaggcatacgacctgttggtaaacggtatcggtaagaaagctgctgacatggtgcaagctatgcaggagtcttacgatgaaggtgtaacggatgagttcatcaaaccgattgtgaatgccaatgtagacggtaccattaaggaaggcgatgtcgttattttcttcaattaccgtaatgaccgtgctaaggaattgacagtcgttttgacgcaacaggatatgccggaggcgggtatgcacactattcccgggttgcagtattactgtatgactccgtacgacgcttcgttcaaaggtgtacacattctcttcgacaaggaaaatgttgctaacacacttggagaatacctggctgctaaaggaatgaaacagcttcacattgccgaaacagagaaatatgctcacgtaacattcttctttaacggcggtcgcgaaactccgtacgataacgaggaccgtatcttggttccgtctccgaaagttgccacttacgacttgaaaccggagatgagtgcctatgaagtaaaagataaattggtggctgccatcaacgagaataaatacgattttatcgttgtgaattatgcaaatggtgacatggtaggccataccggtatctacgaagccattgagaaagcggtagttgcggtagatgcttgcgtgaaagataccattgaagctgccaaagcccagggttacgaggctatcatcattgctgaccacggtaatgctgaccacgctctgaatgaagacggtactcccaatacggctcactctttgaatcctgtaccctgtgtatatgtgacagaaaacaaagatgcaaaggtagcagacggacgtttggcagatgtggctcctactatcctgaagattatgggattggaagctcctgctgaaatgaacggtcaagttttaattaagtaaaagcctgataaacagataggagggcggagttctactccgccttttttataggatagaattatgattcagatagatgacgttgttgtaagcctggatgtgcttcgcgaaaagtttatatgcaacctggatgcctgcaaaggtgaatgttgcattgaaggagatgccggggccccggtagaactggaggaagtggagaaactggaggaagtgcttccggtcgtttgggacgaattgtcacccgaggcgcgtgccgtgatagacaagcagggagtggtgtataccgatccggatggcgatctggtgacttccattgtgaacggaaaggactgtgtgtttacctgttatgacgagaaaggatattgttattgtgccatcgagaaagcataccgggagggaaaagtaaatttctataaaccggtctcttgccatctgtatcccatacgggtaggtaattatggaccttataaggcggtaaactaccatcggtgggatgtgtgtaaggctgctgtattgttgggccggaaagagaatgtgcctgtctaccgtttcctgaaagaaccgttgattcgcaagtttggtcaggaatggtatgatgaactggaaattgtggtaaaagagttacaggatagagggatgatatgaacagacaagtaaagaagatactcaagatcagtggcatcacattgggctctgtactcttggtgctgcttgtagctattgctttcgtgattaattttatcgtaactccgaagaaactgactccggtcgtgctggatgctgccaatcagactctgaatgcacacttggatatggaaagcgtagaattgactttcttttcgactttcccacaatttggactgaaagttaagaacggctctctggtgtccagaactttgaatgatagtaattggtgtaaaaccgattcattgctttctttcaaagagtgtgtgctgactgtaaacccggtggcatatttgacggagaatcgtattatcgttcataatctctctttggacgaagtatcagtgtatgcctaccgggacaaggccgggcaggcaaactgggaagtgacccgtgcttcggcagatacgattccggaagatactgtgtctgctgactttaatagcgaaattgatatccggaatatcgaacttaaacatgccaatctcattttcgatgaccggaatacggatatctattcgcggatagatgatgctaatctgaagttgagactttcattgacaaaaggtgtttctaccctgggactgaagttcgacaataagaatatacttttctggcaacagggagaattgctggtcaataagatagctacttctcttcggacggatattacggtggatcgtcagactgctgtctggaaactgaaagatacggagcttaatgtaaatgggattcaattggatgtgaacggggcattccgtcgggatactgtggcaaaaacgatcggtatggatctggaatatggcttgcatgctccatctatggagacagtacttcgaatgattccaaaagcatatgtgaaagacagtaaagtatcggccaaaggggaggttactgtcagtggcagggtgagaggtgtgtatggtgacaaaaagttaccggctgtgtcattgaagatcggtattaaagaggcttcggcacaatacaagggtttgccgtatggcattgatgaggtgacggcggattttgatgcgtatgtcgatctgatgcgtcatcagccttcttatctgaatctgaaaatcttccactttaagggggcgcataccgaagtactggccgatgcgaaagtagacgacttgttgaacgatccgttgatcacttttcataccaagtcgaccgttgacctggatgcacttgccaaaacctttccgttacaggaaagtgtgacgatccggggtaaactggatgcggatatgggaatgaagtgtcgtctttctactttgaagaagcaggacatcggacgtatgaagttgggaggcaagctcgaactgaatgatttcgaattgaaagatactgctaaagatttcaacttcctgggtaatgcgactttccgtttccgtgataacgagactttgcaggctcaggtggatatccggaaactggtgttgagaagccgtttgctttcttctgatattgaacggttggttgccaacgtaacttctactaatccgcaggatactacccgtatcgtttctttgcagtgcgatatggaagtaagtaaacttcatgcttcgatgggagattcgataaagttatacagtgcccgtgctaaggcccaagcggctttggaacctcaggaagcggatgtaacaaagccggcggttgatttctcgcttcgtgccgattcgcttttcttcagtgcggcggagactcgtatggctatgaatgtggccggtatcaagatgaaagctgagaaattgaatgactctttgtgggtgcctaagggaatcgttggtttcgaccgtttgcgtttccgtacaccggagttcggattgcccatccgtatggcaaagacagcggtaacagtcgatgggccgaaaatcaggctgaagaatgcttctgtccgtatcggacgttctgacatgacggctaccggtgatatggagggcgtttacagggctatgacgaaaggcgagaagctgacagcgcatttatcccttacttccaatctgatagattgcaatcaattaattaattcattgtctttccctcaggacactacggaagtgcttaccgacagtgtaccttcggagatgaagttattcgtgattccccgaaacatagattttgaactgcagacagatttgagaaaggtagtttttgaaaaaatgctttttgaaaatgtgcatggtgcggtagatattaaaaatcaggccatacatctggaagacctttcgatgcgggctctcgatgcggatatgaaagcggtaatggtttataaggccagtagcccgcgtggtggatatgcaggtttcgatttcaaaatccggaatatcaatattgcaaagctggttgatttcgtgccttcactcgacacgatagtgcccatgctccgttcttttaaagggcgtgttatgtttgatgtggcagccgatgcccgcttggattcggctatgaatatccgtatcccgactttgcgttcggctattcatatcaaaggggacagtctggttctgatggatggagaaacctttgctgagatttcgaggatgttgatgtttaagaataagaaggaaaatgtattcgacagtatttctgtcaatgtgacggtacatgacggtaatgtgaccgtttatccgttcctcgtagagatagaccgttataaagcggctatcggcggtgaacaaggactggatatgaattttaattatcatatttccattcttaaatcgccattgccgtttaaagccggagtaaatattacgggtaatctggataaaatgaaattccgcattggcaaggctaagtataaagatgcggttacccccgctgcagtgcatcgggtggacagtacccgtgtgaatatgggtaacgagattgttaaccgcttccggagagtaattaccggacgaaggcccagataaaaagatagtcaaagaaaagcgccggtccgaaggattttccttcagtaccggcgcttcttcgttgtaagatgtgaggttggtgtttatattacgaattatgcatcgatatttgcatacgttgcattctcttctatgaattcgcggcgtggtcctacatcttcacccattaacatggaaaagatataatcggcttctgctgcgttgtcaatattaacttgtttcagcatacggttttcagggtccatggttgtttcccacaactgttgggcgttcatttcacccaaacctttgtaacgttgtgtatgaattgcattttccgaaccgccaccgtaagtgtcgataaacttctggcgttgtgcatctgtccagcaatactcttctactttaccttttttgcagagatagagtgggggagttgcgatatagagatacccattctgtatgatttgcggcatataccggaagaagaaggtcatgatcagtgtgtcgatgtgtgaaccatcgacgtcggcatcggtcatgatgatgatcttgtgatagcgcaacttatcgatattggcagccttactgtcttcttcagtgccgatggtaacgcctaaggcggtgtagatattgcgtatttcttcactttcaagagctttgtgatacattgctttctctacgttcagaatcttaccgcgtagtggaaggatggcctggaatgcacggttacggccttgtttggctgtaccgcctgctgaatctccctcgacgaggaacaattcgcacttttgcgggtctttatccgaacagtcagccagttttcccggtagtccgcctcctgacatgggggatttgcgttgaaccatttcacgtgctttacgtgcagcgtggcgggcagtggcagccagaatcaccttgtctacaatggcttttgcttctttcgggtgttcttccagataatagttcagcacttcacctacagcctggtcgacagcacccatcacttcgttgtttcccaacttggttttagtctgtccttcaaattgaggttcagcaacttttacagagatcacggctgtaagtccttcacggaagtcatcaccggagatttctattttgaccttttccagcattttgctgtcttctgcatactttttcagtgtacgggtcagggcacggcggaaacctgccagatgcgtaccgccttctattgtattgatattattgacatacgagtggatattctcagagaatccggtattatacatgatagctacctcgatggggatgttctgcttctccgtgttcaaatagatcacatcgttaatcaagtgttcgcgtgacgattctatgaagcgtacgaactctcttaaaccttcttccgagtagaaagtttcgtgtttgaagctaccgtcttcgtttattacacgtcggtctgtcagtgagatgcgtaatcccgcattcaagtaagccagctcacgtaagcgtgaggccagaatcttgtagtcatagactgtttcggtaaagatactgtcgtcaggccagaattgttgtttggttcctgtatggtcggctgttcctacttctttgactgcataaaggggcttgccgatttcgtattcctgctggtagattttaccgttacggaatacctgggtggtcatgtgtgtagacaatgcatttacacaagacataccgacaccgtgcaaacctccggatactttatacgagcctttatcgaatttacctccggcatgtagcacagtcatggcaacttcaagggcagatttctgctctttttcgtggaaatctacggggataccacggccattgtcctgtacggtgatggagttatcttcgttgatagttacttcgatatggtcgcaataaccagccaatgcttcgtcgatagagttgtcgacaatttcatataccaagtgatgaagtccctttatgctgatgtcaccaatgtacatcgcagggcgttttctaactgcttcaagtccttccaatacttggatactatctgctgaataagacccgttattggtgggattctgttcttcgctcataatttgattcctaattataataacagagcaaatatagtgaaaatatctgagttagagaagaatgaagagtgaaaaaagaagaatttaaagtaaaccggatgggatggttttaaacatgaaaagccgaactaaaaagttcggctctcaatattgtatagagtctgttataagtcttatttcttaagcaagcttattgatgtaaatagccaacttagatttcaagttgttagctttattcttatgaataacatttgttttagctaacttgtctaccatcttagtgatgcttgggtacatagcagttgcttctgctttgtcagtagttgaacgaagttttctaacagcatttctcatggttttaccataatatctgttgcgaagtcttctgctttcttcttgtctgattctcttgattgatgatttatgatttgccatctcgactaatctgttttaattcgtttatttttttaattgtagcccgtgggggaatcgaacccccctttcaagaatgaaaatcttgcgtcctaaccgatagacgaacgggccatcctgtattgagcatttctgctctttttgtttcgctttgctttcgttctgtatcgttgtttcccgattgcgagtgcaaaggtaggcctttttttgaaactaccaaactatttgcagaaaaaaattccaattatttttgatggatatattatttttctttgtttgtttgttgataatcagtgatatatgttctttttacgttttgtttgggatatgaacttttttttgagataggagtctttgattgtctattcacacttttttcgtagctttgttacccgaaagaaaagttagagatatgctgcaaaaaacagttggaatcgttcttcatatactaaagtataacgatacttcaaatatcgttgagatgtatactgagctttcaggacgtgcatcttttctggttgctgtgccacgctctaagaaggctgctgtcaaatcagtactattccagccgttggcgctgattgagtttgaggcagattatcggccgaatacttcgcttttcagaattaaggaagctaaatcctttagtccgttcgcctccattccttatgatccttttaaatcggctatagctcttttccttgcggaatttctttatcgtgccattcgcgaagaggcggagaaccgcccattgtttgcctatttacagcattctatcttgtggttggatgcttgtaagattagctttgccaactttcatttggtgtttctgatgcgtctttcccgctttctgggattgtaccccaatctggatgattatcatacgggtgactattttgatatgttgaatgctaactttacttcggttcgtcctcaacttcattcttgctatatccagcctgatgaagctgggagattactgcaattgatgcgtatgaactatgagacaatgcaccttttcggaatgaaccgtacggaaagggcccgatgcctggctattattaatgagtattaccggttacatcttcctgattttcctgtactgaaatcattggatgtattgaaggaattatttgattaatatctcttgcccatttctatgtacttcatttggctttggtaatccgtgtctgtaaacaagatacccccggatgtaactctgtgtacatctgggggtagatttcttttaaaagagagtatagctattgtgtagcttctcttataagcaggatttatacgttgagattatcccaacaactcttttactttagttgaaatagcgcgtccttcggccaatccggcaagtttcttggaggctactcccattacctttcccatatctttaccactggtagcacctacttcagcaataatctctttcagtgcagtttccagttcttcggcagtcatttgttttggtaaataggtttccatgacttgtacttgtgccaattctgtatcggctaagtcctgacgaccctgtcctatatatatttctgcagcatctttaccttgttttaccagtttttgcacgattttcagtgcatctgcgtctgtaaggatgtcattggctcccggagcggttttagcttccagaaagaacttctttacatttctaagggtttcaagggctactttatctttcgctttcattgcgtttttaatgtcttcgctgactctttcgaataaatccatgatgttatgttatattatgatttaacgatttacggtttataattggtaaatccgggttaatgatcgatatatttagctatttattaaaatgtgataactccactgtcatctatagcttcttcagtagctatctcttcttccaatgcggcttttgctttgatcttacctaaagtcgttttgtcgcgaaggtaagtaggagagtcttctaccatggcgatgatatcatcattgtccagatcttccggattgaagagatagatatgacggcgtttccgcaggttgcgtgttccgatgccactggcactttcaccatatgctttacgaatgcgctctttgttcttttccttctcttcttccagctgcaactgacgttcttcttcttcctggctgcgtttctcgtgtaggtcgtccatacctggtacgtcttccacaccgaaaccggtagcaagcacagtgatcttcactttcgtatccagtgaggtatccatagccacaccccagatcacttctacaccttcgcggaatttgctcataaactcgtgtacttcattcatctcctccatcatcagttcggaagcaggacagaacgaaacattcagcatgactttcttcgcattgaagatgtcattgttattgagtaacggtgaatggagtgcgtcgtcgattgctttggttacgcggttttctccttcaccgaatccggtactcatgatggctacaccaccgtctttgaggattgttttcacatcagcgaagtccaggtttaccgtaccccgcatggtgatgatttcggcaatacttttggctgcgattgacagtgtgtcatctgccttgccgaatgcgttcataaaggtcaggtcggaataaatttcacgcaggcgttcgttattgatcaccaacaaagcgtctacatgttgggcaatgcgttctactccatccagagcctggataattttcttttcgccttcaaagataaaagggatggtaacgattccgacagtcaggatatccatctctttagcgatacgggcgatgacgggggctgctccggttccggtacctccgcccattccggcagtgataaataccatcttggtaccatcattcagcaggttttttatgtcttcgatgctctcttcggcagcatcacgtgcacgctccggacggtttccggcaccgagtccttgcgtgatggaacgtcccagttgcagtttgaccggtacaggagactcagccaatgcctggttgtcggtattgcagagaacgaatgtcacgtcgtgtatgccttcccggtacatgtggttgacggcgttacctccaccacctcctacaccaatcactttaatgattttcggcgaatctgtagggaaatcgaattgtactatctcgtccatattatattgtattatgaattatcactttatttcatatcttcatcggagaaaatctcattagaaagtttgtcgaaagtcgatttaaaccaattcggtttgtttcttctttcttcttctcttctttttttctcctccagtttacgttgcttttcttcttctttccgtcttttttcctcttcctcttttttctttttggcagcacgtgcagcggcttcctgttctttcagactctcatcttcttcaaacatattcaccggttcgggttgaggctgaggttgtacatgcggctggggagcaggtgtctcttgcaggcaacagttttcattgccggcagcaagcagtccgaataaggtgttctgtgtaccgtctttcttcacaacatcttcgtctgcatgaatggtgttgcgtacgaatcgtgcgcttctcaccttttctatcttacttcgtttacggagagcttcgtccaggtttttcagattggaggctcctcctgtaatgataagtccggccaacagtttatcatcataccctgaaagttgaatctgattccatacgtttgcaataatttcttcagtacgcgcctcgatgatattattcagtttgccgagttctacggttctacctccttcttccagttggcaggtagcaggttcttcgccttcttcctcttcgtaaaaggcgttaccatatctgattttcaggcgttcgccttcttcctcttctatctgaagggaaacgagatcatgagtaatgctgtttcctcctaatggcagtacggtaaggaatcggagaatgttattcttatagatggaaatagtcgatgtgtcggctccgaaatcaatcagtgcacagccggaacgtctctcactttccgtcagcactgcatctgcagtaaccagcggggagatcaataaatctgctatttcaattttagcttgttcgaaacagcgttccaggttttttttgagcgaagcacgtgccacaatgttcagaaagcgtccttcaatatggcttcctgccacaccgacgggatctgcctggagattgtttccaattttgtattcttgcggagcaacgtccagtatatccatatcgatcagtggtatctcaagattttcatcacagatggagtcgactaattcctgagagataatggtctcctcctcaagatcgcgactaactacattgcgtaccgtacggagcgattgccccccgatacccacatagatcttggcaattgagttgttgagagtaccctccagcttattgatgatggaggtcaggctttgtgccgttttatccagattgtaaatcactcctttccggatgaatgaagacgaatcctccctggcataagctaatacctgtatgcttccatcactattcttctttccggctataccggctattttcgatgaacccagttcaatagcggcgataaaatctgttgttgccatataaaattctattttattcccttttgtattatagactcatctctttaacacaaaggtacgtttagctgtttacgaattattgtttcttttttgtgcagataatctgattaccgaattccaggctgatgcgtgaatatttgttccatcccacctggttcagccctttttcgtaaaaggtcttcaatcgtcccagtttatcctcaaaatgttctaacttgcccagatagataatatgattacctacacggggaatcaattcgatctctttcccggggagcacgtttatttgcacaatctgggcttcccagaacggattgttttgcaaaaatacaccaaacttatataaatccttcattgcaaacgacttttctacatttccggtgacaattgcccggtgtgctacgcattttgcatcgggaggcatcactttacctttgttatccagatagtagttttcgccattgttgctcatgatgcggagaatcggtacacgttgtgtcacttccacgcaaagtttgccgcttggagttttatagcattgtgcttcattgatcagcggatgcttgttcaactctttttccagcgttttggtgtgaatgcggtccattttctttccaacgggataaatgcctttcttttgcaggatggcagctacctcgtttttagtgacgaaaccggcattgagcgtatcctttattactaattccatgtcgcggcagacctgatgggcaggtttgctgttgaatactgtcacagccgctacgagataggctatgagaagtaacatgacgatggtcagaaggattctttttatcatgaggaaatttattgttttgacgatttacaaattaattgtccgatggagttatccttcgggtcaatagttcacaaatatccgggacatagctatctatgtctcctgctcccaacgtgatcaacacctcgatatgcttcgttttcagcacatcgagtatttcctctttcttacacatgcttttttcaatacccggacgtaggttatcatatatcagttgactggttacccctggaataggctgttcgcgcgccggatagatatctaccagtattacttcgtcgagtagcgacaagctatcggcaaagtctttatagaagtcccgtgtacgggtatagaggtgtggctgaaaaacagcggtgatctttttatcccggtagagttcacgcatggacatcacactctgtttgatttcggagggatgatgagcgtaatcactcaggaacacgatctggtcgtttttgatcttgaagtcgaatcgacggtccacacctcggaaacttgccattccttgtttgatttcttcggcggtcactccattgagataggcaagtgccatggcagcgactccattctctatattgatacttacgggcactcccagctgaatgttgtcgatgcgaatatccggtcctataaaatcgatgaagatttctccgtttccaatgcgaatgttttcagcatggaagtctcctttatcgcgtgaataggtgtaaatcttgacaccctcttgcactttaggctgaagagaaatgccttcgcggatgatcagtgcccctcccggctggattaatgtggtatagtgctcaaagctttccagataagcctgttcggttccataaatatccagatgatccggatcggttgcggtaatgacagacatatatggagacagccagtggaatgaacggtcgaattcgtcagcttcgattacggtatacggactgcttggagagagtaacagattcgttccataatttttggaaatacctcccaaaaaggcagtgcagcctatatgcgagtgatgaagcagatgggccgtcatcgttgatgtagtggttttaccatgtgtaccggctacacaaagccctttactggaatgagtgatggtgcctaatacttgtgcacgtttttgtatttcgaatccgttgtcacggaagtaagtcaattcggcatgttcctgaggtacggcaggagtcaaaacgaccagtgtcgtggccgggtctttacaggcatccgggataagattgatattttcttcgtaatgaatctgtgctccttcttctataaggtgttgagtcagttcactgggggtacggtcatagcctgccactaccttccctttagaaaggaaatagcgtacgagggcactcattccgatacctcctgcaccgacaaaatatacagattgaatagtttctatgttcatggctgttgtgctaattttataacttcttttgctatcacgatggcagaatccggtagggccaggtgagcgatgttttcactaagttcttttagttttccgaaatctgctatggtttctaatgctacggataataatttctcttccgcttctgcgtcctttacgtagatggcagctcgtttgttcaccaatgccaatgcatttttggtttggtgatcttctgctacgttgggagacggaaccaggataactgctttattcaacaggcagaattcggaaatggagccggcacctgcacgcgaaataaccaaatcggcagcagcataagcggcagccatatctttaatgaagtctgtcacatacagattaggaatgtttccggcaacttttacggcttccgttacttgctggtgatagatttttcctgtttgccagatgaattgtacatttttagtctgacgaatcagctgcaatccggcaatcaatgtattattgattgtgcgggcgcccaggcttccccccagaatcagaatggttttcttctccggatccagtccgaaagagcgaatagcttgtttttgttccggcttctccgttaacagattctgacgtaccgggttgcctgtcataatgattttgctgcccggaaagaatttttccatcccatcatatgctacacagattttccgtgctttctttgccaatagtttgttggttactccggcatatgagttttgctcctgtattaaggtgggtacacccatcattccggccatttttaatgtcggaccgcttgcatatccgcctactcctactgctacctgtggacggaactgacggataatgctgcgcgctttccattggctgcgtgccaatttcagtaatacggcaacatttttccacaaatgtttgcgatcgaatcctgctacgggtaatccgatgatctgatagcctgcatccggtactcgttgcatctccattcttccttcggctcctacaaacaggatttgtgcatcgggacgtaattcttttatggcgtttgcaatggatacagccggaaaaatatgtcctccggtaccaccgccactgatgatgatccttaaaatgtcatcccgtccctctttattattttccttattcatatcactcttcaaatttagcatcactgtttaagacttccgctgtaggctcagctgctgtttgggcttcgcttgcaacggtttcactcccttcttctccggtaaggaggggagcgggattatcttttttctcttccagataagccgtataacggctgacactcaatatcattccgatataggcgcagttgatcagggtacttgtccctcctttactgattagtggtaagggctgtcctgtgacaggaaacaaaccgacagctaccatcatgttcaatatggcttgtgataccagcatcaaggcgattcccatgacaaggaatgccggaaatgtacgttcacatttctgggcgattcggcctgttcgaaccaacagccagatgtagagaataaccacaaaggctcctcctaccagccccaactcttcaatgataatggcaaaaatgaaatcggagaatgcctgactcaggaaatcgcgttgaatcgagtttcccggagctttacctatcacgttactggtagcaatggctatacgtgcatgggctatctgggcatctttgtcaatatcgaactttgcagccggtacttcctctttctcagtgaagttggtgatacggcttttccaggtatcaaagcggtggaggaacggaatgtcggtgtctttaggtatggccagcaggaagattactcccagacacccagccagtgccagtccgcctaataacatagctaactttttgaaggcgacacgcccgatgaacatcatcagtactacgactccgaacagcagcatagctgtcgaaagattttccggagcaatgagcatgcacaccagtccggtcagtatcattatatatttaaaggcttttggattggctccttcatcatcctgttttttggaaagaataaaggaaaccgcaatgattactgccatcttggccagttccgaaggttgaaactgtaatcccataaaactcatccagcgggcagccccatttacacggtcgcctgtgatgactcccatcaatgtgacgaaagctaacaacactaccgaaatggggtacaggaagaccgggaacacctgaaaccatttataagggatgttgtgcatcaaaaccaccacgattgcaccgatcatcaggatgatggaatgctgtgtgatgggtccccagtgatcaccacttttataagtcagtgtactggcagcactaaacacctctataatagagatgaggcagaggcaaaggaaaatgatccagattaccttatcacctttgaatatgttctttaataaatccacggcttttagtttttagctcttaggagtcctgcctttttaaagctcagagactcttatttcataattctcttacatactttttaaattggtcaccacggtcctcataactcttaaaaaggtcgaatgaagcacagcacgggcttaacaataccgtttcacctttttttgccagtttgtaggctgcttctacagcatccttcataccggtttgtacttctgctacgggaagtcccaggcgatcgaagaactcatggagtttttcgttgtgcaatccaaggtaaaccaatgccgagcatttttcccgaaccagctcctctatttccgtataatcattccctttatctttacccccgaggatcaacactgttttggtggtcatactttgcagagcgtaccagcaagagttgacgttggttgctttggagtcgttgataaaatcaatcccccgtacacgtgctactttttccaaacggtgctctaccccttgaaaatcgctgagcgcccttcgtatattctctttggtaatgccggccagatttgcagaaatcccggcagctaaagagttataaaggttatgttgtcccgtcaaagccaattgttcctgctccatgttgaaggcaattggtgcggtaatcactacttcatggtcttctacataagcgatagacccttcttctttaattgccgagaatggatacaggtgggcacagatgccgtgtttatccagttcacgtttgatgatagggtcatcattccagaagataaaagcgtcttctgatgtctggttctgtgtaatacggaattttgcgttgatatagttctgcatgcagtgatcgtatcggtccagatggtctggtgtgatattcatcagcacggcgatatccgcacggaacttatacatattatccagctggaatgaactcagttcaattacataatagtcatgctcctcttccgctacttgtaatgccaggctcttaccaatgttgccggcaagtcccacatttaatccggcacttttaaagatgtgatagataagtgaggtcgtagttgtttttccgttcgaaccggtgatacagatcatctttgcatcagtgtatctgccggcaaattctatttcagagataatgggcgtaccctgctctttcaatttcagaattaggggggtgtcattaggaattccggggctcttcaccacttcatctgcattcagaatccgttcttctgtgtgccggccttcctcccaggcaatgccatggctgtcaaggagagttttatacttatccttgatggcagacatatccgatacgaaagtatcgaatccttttacttttgccagaacggctgctcccgcaccgctttcaccggctcctaatactacaattcttttcatgatttttagttatggtttatcaaccggagttttgtgtacggtcggtaaatcctttgtctctatgctacaagtttgaggttcctactcagtgatcggcagcaggcacttgtagcttgtagcctgttacctgtcactttgggttatcttatctttagtgttataatcgtaatggctgccaacacgatggttacaatccagaagcggactgtaatcttggattcgtgaaacagttgatccggttttgtaaatttcacactgcatcccggttccaccaggctcatcgaagtgcggaaatggtcatgtatcggtgcccgtttgaaaagacgttgttttaccccttttcttttgcctgctttataatagaagcgttgcaggagtactgacaggttctcaaccaggaatataccacagagaatcggaatcagcaattctttgtggataataatagcaaatactgcgatgattcctccaatggtcaggctacctgtatcacccatgaatacctgtgccggataagcattgtaccataagaaaccgattaatgcgccgataaaggcacatataaaaattaccaattcttcacttcccggaatatacatgatattcaggtaaccggcgaattcaatatggctcgatacataggccagtatacccagtgtcagtccgatgatggctgaattgcctgctgccataccatccataccatcattcagattggcgccgttggatacggctgttacaacgaagatagtgataatgacaaacaaaatccatccggccgtttgggcatgttctcccatgaagcccacaaggtctgcatagtccaggttgttgcttttgaaaaatggaatcgtggtctgggttgatttcaggtcgtgggtgccatgtatcacttcgatttcgttttctgatttctgaatctctatattctcgcggattactacattagggctcagatatagagtcagtccgacaatcagcccgagtcccacttgtccgatgattttgaatttgccatggaggccttctttatctttcttgaatatcttgatatagtcgtccgcaaaccccaaagatcccagccatacagtagttatcaacatcaatatcatatagatgttatgcagttttcccagtaataaacagggaatcagaattgctacaataatgatcacacctcccatactgggtacgcctactttattaaccccaaacggatcgatcttagcgtcacgctgcgtttcggtgatttgtttccgtttcagcagattgatgaatttgtctccccagatactggaaatgagtagcgccaggatgacagccatcaatgcccggaacgaggtgtacccaaacattccggcacccggaaagttgagtttatgtagccattcaaacaagtaatataacataactttatttacaatgagacgatttatggtttacgattgaaggaatcaggcatttggcatcggaattacttcaatcattgtccgttaaatagtcaatgaaaaaatctcttttaaaacctctttatcatcaaagtgatgtttcactcctttgatttcctgataattctcgtgtccttttccggcaaccagaatcacatctcctttttcagcaagcatgcaagccgtgcgtatagcttccttacggtctgcaatgctcagtgtttttttcttgtcttcgttgtccagtccggccaacatgtcattgatgatgtcctgtggctcttcgaagcgtggattgtctgaggtgatgataacccggtcgcttcccttggctgcttcttttgccatgatgggacgtttgcctttatcccggttgccaccggcaccgactacagtaatcactttgccctttccttcaagcactccatgtatggcgttcaagacgttgaccaaagcatccggtgtgtgtgcatagtctacgatcgctgtatatccttgcggggagcgtatggcatcgaaacgtccggcaacaggatgcaacgtactaagtgcaaccaatacctcctcttccttcttacccagtaaaacggcggcgccgaatacggccaataaattcgaagcattgaatcttcctataaactgcactgcgagctcatggttgttgaagtcaagaagcattccctcaaaatgtgactccagtactttccctttgaagtcactcaggctgcggagagaatacgtgtatactttcgacttcgtattctgcgtcatcacgagtccgtttttgtcgtccagattggtgaggctgaaagaacttttaggcagttcatcgaagaatttcttttttgctttcagataattctctactgttttatggtagtccagatgatcgcgtgtcaggttcgtaaagatgccgccggcaaacttcagtccgctgattcttttttgcgcgatggagtgcgaacttacttccatgaaagcatatttgcagccttcgtctgccatacgtcccaaaagacggttcagcgtaatcgggtcaggagtagtgtgctcggtagggatggcttcatcgtctatataattgcataccgtagagataagccccactttgtaaccgaaataccggaatgtattatataataaggtggcaatcgtcgtctttccatttgtaccggtgacacccaccagttccattttcgaagtcggctctccatagaaagccgtagctactttaccaacagcatcttcactgtcggttacctgaatgtaggtaatttcttcgtttagttctgcaggcaactcttcgcagagaatggctatggcccctttctcaattgctgccgggatataggcatgtccgtcggtttgtgtaccgcgcatggccataaacaaatggccggaccctacctgtctggagtcgatgtcaactccggttatttcgatatcctgatttccggttatttttaccggatggatagatgttagaatctcttttaatttcataccttaatctataataatcaattcagatggatactgatggtttgtcctttctttattgtagtaccctggggcaacgattggcttctcactttgccaactcccgacagagccactttcaatcctttgctttccagcaggtaaacagcatctttggctcccatgccgataacgctgggtacaaagttccgtaattgttcctttccctgcaggatcactgctttgggagctgcctgtgcatgtccccaaacttctttattctttttagttttaaactctgcctgagtctgaatattcaatccttccaatacttgtctggcctctgtcatttcgcctgctttaacatcgggaatcactaccgtattggtatcgattgcgttccgaatgtccaaacgtaggtctttggcatacactctttcggcaattttgctgaaaacgctaccggccatcaagcctccggaggcaggaggatttggcttttgtatggaaacgatacagctatactttggagcttctgagggaaagtatccgcagaaactgaccagatagttcactcctcccgatgtatatccggcagcaccttgtgagatctgcgccgtacccgtcttacccgaaacggcaaattgtttggagcctgccggggctgccagaccttcatgcacaaccttataaagaatctcctgtatttgtttcagggtccgttccgaacagattctcggattgataatttctgtcggatattctttcactatttcaccattttttatggctgctttcacaaatttgggacgcaccataacaccgttgttggcaatggcattgtagaaagtaaggatattcatcggtggtacctgggtctcatagccgatgctcatccacggcagagtggtttttgcaaagtaacgctctttcggacctttgatattaggcttaccttctccggctatttgcaattggagaggctgatcgatactcattcgtttcagtccgtcgacaaacttttgcgggttactaccataatatttatcaataatgctggatgtacccacattggaagatacttccagtatttgtgtaactgtcaatggaccatatccgcctttgcgccaattccaatctttcatgggacgaccgtacatcatcttgacaccattgcctgtgtctattacatcttccggtgtgattttaccgtcttcaagtgccaccatgatagaagctgtcttaaaggtagaacccggctcgagcatatcactgatggcattgtttctcatttcataatagttgccgtctccggctttcatcatgtttacgatggctttaacctctccggtcgctacttccatcaatacggctactcctactttggcattcagctctttcagtttatcggtcagggccttttcacaaatatcctgcatgcctacatcaatcgtagaaagaaggtcacaaccatctaccggaggaatatctacaatattcaggtatttattcatcactttttgccggtgggtaatcccgtcatgccccttcagtatggagtcaaaagctaactctatgccattcttggcaccttgggcggtgtcagcatataagtcccccagtgtgcgggctgcaagtgaaccaaaaggtttttttctttggttataagctaactcgtggaaaccgcctttgtatttattcaggttgaataccggcaggcgtttggcttctttatattggatgtatgaaatacgttttggataaatcagatagttgcgacttccctgtttccgtccttttttaaggtgcgctttaaattccgaagcacttttatcagggaatatcttatggagtcctgcacatatttcgtccagatgattcatcagcatggtgtccttctttactccaccggctttgaaatccatataaatgcgatattccggcagcgaactggccattagtttgccgtcggaagagatgatgtttccgcggttgggctttaccgttacattctctttgacgaaacggtcggctacatcctgccaatattgacgttcggcaaacatcgtgatgcctgctttgacaacaatggctactccaatcaatcccatcagcaggatgacgaagaagtaacgggtcattatatttttcttgtttacagccatcttttatttcgttctgattaaataaggtggattggtcgatgtctgcaaatcactttctttggtggatatatagtcctctattcgtgactggcggcttttttccatcagttccgaacttcgggtcagtgcatcgtatttgatgtcaatcagctcttttttcaacttgtctatttcgatttgctgttgctggcttgcgtaacgattatgaatgtagaaaatgacaagcaccataatcagtaccagcaatttagtctggcggcgaaaaaaatccgttgccagaatgtcacctcccagaatacttttcagggaattgcttttcttcttttttgcttctttatcttccatttcacttctcttatttcactctgttctcttatttcttttcggctattctcagtttggcactgcgtgaacgcggattgcgtgctatctcttcttcatcgggcacaattactttgttgtttaccaggcggaagggagtttgcaggttgccgaaaaagtcctgcgttgttttaccttctacattaccggttttcatgatgtttttcaccatgcgatcttccaaagagtgataggtgattaccaccagccgtcctcctggtttcaatgcttctgttgctgccatcagcatttccttcagtgcttccatttcctggtttacttcaatgcggagtgcctgaaatacctttgccaattctttcttttcgcgttcgcgtccgaaaagcggtttcactacttcaagaaattcaccgatcgtttctattttctgtccgctgcgtgctttgactatgacggaagccagtttgcggctgtttttcagttcaccatataggtaaaaaatatctgccaggcgttcttcttcgtatgtatttaccacatcggccgctgtgatgcctgcacgcttattcatgcgcatatccagttttccgtcaaagcggaaagagaatccccgttcactgtcatcgaagtgatgtgaagatacccccagatcagccaatatggaatctactccttcaatatcgtggtagcgcagaaaattatgcaaataacggaaattgctccgtacaaaagtgaagtgcgggtcgtttacaatgttacgttcggcatcctcgtcctggtcgaaacccaacaggcgtccgccgtttccaagacgcgaaagtatttcgcgggaatgtcctcccccgccgaaggtaacgtctacatacgtcccgtccggggtaatgttcatggcatctacgctttccttcagcagtaccggtacatgatatgttgtttcttcttctttcattttacctctttgttcgttgttcaccgttcttctttcataatttcctccagggctgcaccaaatgcatcggggggcataaagggcatttccgtacgttccttagcccatatttctatcttgctgtctacaccgataaagcgcacgtcgctttgtatgccggctatttgcagatagcgtttgggtattaatatccgcccgtttccgtctatcgtgataatttctacatcactgacgaattggcggaagataagttggtggttagcgttccatttatttagtcgttgccggagttcattcagctcttcattccagacttcttccggatagagtaccaagcagtcttgaaatacgtctttgcgcatgatgagcttgtcttcagaaccggcttgtagctgccgtctgaattgggcggggataaaaactcttcctttcgcgtccgccttagcttcaatattgcctaaaaaacgtatcatttcaccttattataataagcgaccgtaaaagtaggtatttccccacaattccccacaattttccaccaaaaactttcggagaagttttcaaccgattgttaattgcttattcgtctgataatgaattatgttcggagatgctttgctggtgggggatagagtcggttgtatccttcccggagccgttttgtggctttgtgggcttccgtccgtattttagttgcagactgacaaaatcggttttcctcacgttgttcaggaaagtcggggcggctttgaagcaaatgcgggatacccatactttgttggcggtacattcttccggtttatccaccgcttcactggtgatgctgggataaaaattgcccaatccatcgatagaaacggtgcggccttccttcaagtgggcggcaataatgtccgatagttgagtaagtgcagagagtacgtctccgttttgaagagaacttctttctgcgagctgattagcaatctgtacactgtttacaggctttttctgtaaagctcgtgttgtggcataataacgttctttgacgacacctttacttttgtctactttcttagtgactgcgtagttgatggacattagtacttcgtttttttttatgtgtatactttctctgtctttctcttattgtgttaatctataacatctatatctaatgattaaaaacatccggatgtttatggataaaacatccgggtcttttatagaataacatccggatgttctatattaatacatccggatgtttttaatcataaattttaagcaaagatatgctaaagtgagaatattagcaaggaaatatgggacgtttctttgttttatgtttcaaatggtgcgaaagaaaaggagcagaaaaagagaatctctcttcctgctccttgatacacaactaaaaatctgcactaaaatgatttattgaaatcgacaatgtatgtggcctattgtctaaagtctttcagttcttcctgtagacgctggcgagtgaaaaagatgcggctttttactgttccgagcggcaggtccagtttctcggctatttctcggtatttgaatccggaaacatgcatggagaaaggtactttatattctttgggtaatgaattgacaatgcggtgcatttctttcaagtcataacggctttcggtgctgtcgaatccggactcttgcggaaggctcaggtgatagaggttatcggtctgatctacaaaagtctgatcgcgtaccactttacggtagttgttaatgaagatgttgcgcatgatagtgtacatccatcctttaaagttagtgtcgggagtatatttatcttcgttatctaacgctttaagagaggtttcctgcaacaaatcgtttgcttcttcacggtcggttgttagtttgtatgcaaagcgaagtagttcttcctgaactccaattaaatcttttctgaagcttaaacttttcataacgttgctttttaaattgtgaatattcgttgtttttcgatgatgcaagtttacggcatttttttaattgtgatgggggaaatttaggcttaaaacagggcgaaaactgtcaaatgatagtttttaggtgtattttgatagtttttgggtgtttttgagacaagaggttttctatctttgcgtcggtttaaatatgaatggacatgaggagaaatactatacataggatttggcttgcatggatgttgctgatgacattcatgcccttgtccgtggtgaaggtttttcataatcattgcgatgaaacatcggtaacctgcacaaatacgcagcccgggaaaacacatcacgcatgtgacacctgtcccatttgccaattcatgctttctccattcatcgagacgtctcctgctcttttgacttatatacctttctatataagatgggagaccggaacttttcaggataagaagcttgctactgctttttatccgcattatcttcgcggacctccttccaattttcgtcatatcgtataatttctcgggcagatatctgttgtttgcccgtttatcagttttatctaactaaaacgattaagtatgcgtatcggatttatttcgggtatgctgggtggattgtgtttaacctctaccttgcatgcccaggagcccgattcactgaaagctgtgtccttatccgaagtggtggtgacggagagttaccgacatctgaagaataagaattcgacatggcatatggaagtggtagggaaggagtttttgcgtgaacacttcactggcaacttgatacagactcttggaacgattccgggaatacattcgatggatgtcggttcgggcttttctaagccgatgatccggggaatgggattcaaccggatttcggttgtagagaatggaatcaagcaagagggacaacagtggggagccgatcatgggctggaactggatgcattcaatgcaggacaggtgactatccgtaaaggacctgcttcactgctctatggcagtgatgctatgggaggtgctattgaattggctccattaccattacccaccagtagccagttgtttggtgaagcggacttgctgggaaagtctgtaaacggaacgttgggaggctcgctgatgcttggaataaagaaagacgcctggtatacctgggcgagatattcggagcagcattttggcgattatcgtattccggcagataccattgtgtatcttacccaacggatgcctgtctatcaccggaaactgaaaaacacggcaggttttgagcgagatgtcagttggacagccggtttcaggtatggacgatacaagtcttcctattcagtaagtaatgtttttcagaaaaccggtttctttcccggagcacacggtattcctgatatatcgcgtttgcaggatgacgggagcagccgcaatatagaactaccttacagtcaggtgaaccatctgaaggtatctgcccagcagagcttcttgtgggatcgatcggcattgatatgggatatcggctatcagaagaatcatcgtgaggaatggagccggtttcatacccattatgatactcagcctgttccggagaaggatcctgacaaagagttggcttttatattgaatacttatagttcggctgttaagttgaagttgtttggagctgcttcgtggcaacatatagcaggttgggatatacagtatcagaggaatactatttccggatattcattccttttgcctgcttaccggagattcaccacaggggctttctggatgacaacttaccgtccgggtcctgctttgtcagtcagtgggggctttcgctatgattacggaaagatagatgcatctgcttatactgatccttatcttgcggtttatctgcgggagcagggatatgatgatgattttatccggaaatatgagtggcgtagctatgctgtccatcgccattttggtgactattccggttcgctgggagtggtgtggaccccttccggaggacacatgcttcaagtgaatatcgggcatagtttccgcttgccgggggccaatgaactggcatcgaacggtgttcatcacggcactttccgtcatgaacagggagatgcggctctttcgtccgagcgtggttggcaactggatgtctcgtatacctatgagaatggtccgttatcggtcaatttttcgccatttatcagttggttcagcaattacatctttcttcggcctaccggagaatggtcggtgttgccccatgccggacagatttaccgttataccggtgcggaagcgttgtttgcgggtggtgaggcgacagtgggaattgactttttacgtcatttcaactatcgtgtcagtggagaatatgtctatacttataattgtgacgaacatattcctctgagtttttcccctccggcttcccttcgcaatacgctgacgtggaggtataaaaacttcagtatttatggtgaggtacagcacattgccgcacaacaccgggtagcacggaatgaggatcctactcccggagcgcagttactgaatgccgggatatccgccaatctccgtatgggaggtgtattagcagaaattactttatcgggtcggaatttatccgataccggatatcttaatcaccttagtttttaccggaaagttgaaatcccggaaccgggacgtaactttcagattttaattaaagtaccatttaaaagtttattaaaatgaaaaccagaatttatttatcaataatcggcctgatggctttttctttcttgtttgtgtcctgttcaaaagatgacgaaggcgatacggtaaagcccgttattaatctgttggaacctgaagaaggtgcagtgttgaagatcggagatgctaacggagtgcattttgagatggatatagctgataacgaagcaattgcttcctataagattaatattcataataattttgacggccattcgcataccagagcttcagaaggaggaacaaccaaaccttttgcttttgagagaacatatacggataaggcaggccaaaaacaggcgcgtgtacataaccatgacattaagataccggcagatgccactccgggaaattatcatctgatggtatactgtttggaccggtctggtaatgaaacttacgtagcacgtaatatcgtattaagtacgacaggcggtgtagagagtgagcatcaccatgattaagtggaatacctgaacctgaatatggacagggccataccgacggatgggaagtttaaactcccgtcttcaggcatggccctcttttgtgtattgttctttatcgcttgattattagcactctttcttctcttttttcttctccattttctcataaatcgccttctttttctttttttgataggacaaaatctgtattttctaccgatttattgcgattaataaaaaagaacagttaattttgcgcaatcatttcatctaaaaagaatggctgacgactctttatttttaatagatattgataagatacttcagacgaaagctccgaagcactacaagtacataccaaagtttgtcgtctcctatctgaagaggatcgttcatcaagaggagctaaacgtttttctgcgcgactcaaaagataaagtgggagtggattttctggaggcttgtcttgagtttctggatgcaaagctggatgtgaaaggactggaaaatattccgaaagatggtttatatacgtttgtgtccaatcatccgttgggaggacaggacggagtttctctcgggtatattttgggacgccgttttgacgggaaggtgaagtatctggtaaatgatttgttgatgaatcttcgcggattggcacccttgtgtattcctattaataaaacgggtaagcaggccaaagattttccgaagatggtagaagccggattcaagtcggatgaccaactcattatgtttcctgcgggactctgttcccggcgtcggaatggagtgatccgggaccctgactggaagaaaacatttattgtaaaaagtgtccagtttcagcgtgatgtggttcctgtccattttgagggtcgtaattctgatttcttttataatttggctaatgtctgcaagacactggggatcaaattcaatattgctatgctttatttggcagacgagatgctgaaaaatcgtcataaaacatttactgtcactttcggtaaacccattccatggcagactttcgataaatcgaaaactccggcagagtgggcacagtatgtgaaagatatcgtgtataaactgtaacagattaaggaacaactactaacaaagtatatggaagaagttattgaaccggtaagcaaggagctgattaaagctgagttgactgaagacaagcggctacgtatgaccaataagagtaataaccagatatatattattacttatcaggattctcccaatattatgcgggagatcgggcgtttgcgtgagattgcttttcgggcagcaggaggcggtacgggattatcgatggatatcgatgagtatgacaccatggagaatccgtataaacaattgattgtctggaatcctgaagcagaagaaattctgggaggttatcggtacattctggggacagacgtacgttttgacgagcatggtgcgccggttctcgctacttcacacatgtttaatttctcggataaatttgtgaaggagttcctgcctacgactattgaacttggacgttcgttcgttacgttggaatatcagtcaacccgtgccggaagcaagggattatttgccttggataatttgtgggacggattgggagcattgacagtagttatgccgaatgtgaaatatttctttggtaaagtaaccatgtatcccagttatcaccgtcaggggagagacatgattctgtatttcctgaagaaacattttggggataaagacggactcattaccccgatgaaaccgcttgagatggaaacagaagaggcggaactggcgagaatcttctgcaaagattcatttaaagatgattatcggatactgaacggtgagatccgtaagcttggctttaatatcccccctctggtaaatgcttatatgagtctgagcccgactatgcgtatgtttggcacggctattaattatggatttggagatgtggaggaaaccggtatcctgattgctgtagatgaaattcttgaagaaaagcgcatgcgtcacatcgaatcgtttgttaagaacgatccggaagactgccagataacttccggtgtaaataaagttttcactccgaaagtggttacaccgcaggaagactgttcccgttaattttacgataaagatccagggcaaagacatcggtcatgcccgaaatataatcaagcaccgcctgtactctttcgtagagtgcaggcgcttttatattatattgccctgatacgcggttaataagcagctgtgaataggctttctccggcgaagtgacagcatctatcattaattcaaggagcgtgttgatgacccggaaacctgctaactcaatgtccagtacgtcccgtgaacggtaaatcttcttaaacgatacttccgagcaatgtttgtatgctttttccggacgctccgagatgtgcttgataagaggtccttcaaatgtgccggaaaggatttcggtttcgttatctaagaatgcccaggtacattccttgatcagcaggccaatgacagaagaacggaggtaggctatctgttcgtttgtgtcgttgacaatgttgaatgttttacgaatacgtgattggcgttcctctgtgaaataagccagaagcagctccttagtttcttccgtagtcaggattttcaacttgtgggcatcctcgatatccatcatttggtaacagatgtcatcggctgcttctacgaggtaaactaatggatggcgtacgtattttaatggctggtcactaatctggataagtcccagttccgttgcgatgcggcggaatccttcttcctcggtcgtgaaaaaaccgaacttggacttgtttcctgcaaggctcgatgaaaaaggatatttgacaatagaagccagggtagaataagtcagtacgaatccccctttccggcgtccttcaaactggtgtgtcaataagcggaaagcgttggcatttccttcaaaatgtgtcaaatcatcccattccatcggtgaaagctgatcttgcagccgtgttcctttaccttccgagaagaaagtggaaatcgctttttcgccggagtgtccaaagggagggttgcccaaatcgtgtgccaggcaggcggcagaaacaatagagcctatctccggcagaaaagagtcttgtaattggggttgccgtgtgaggatcgcttttgatacatcattgcccaaagagcgtcccacgcaagatacttcaagactatgcgtcaatcggttgtgaacaaatatactgcccgggagcggaaaaacctgtgttttgttctgtaaccttctgaaaggggcagaaaaaacaaggcggtcgtagtcccgctgaaattccgaacggttttcctgacgctcctcgtgaaactcttccatgccgaaacgtttagctgaaatcaatcttttccagtccatcatgatctttacaattgggtatttgcacattatttaactgcaaaagtatgaattttaggctcaaattgcgtattttcgcccgttaaatagtaaacatactgaatatgaacgtacaagtaatcaataaatcgaagcatccgcttccggcatatgcaaccgaactttctgcaggaatggacatccgcgctaatatttccgaaccgatttctttagatccgatgcaacggtgtctggttcctacaggactgtttatcgctcttccacagggatttgaagcgcaaattcgtcctcggagcggactggctttgaagaaagggattactgtgctgaattctcccggtacaattgatgcagattaccgtggggagatttgcataatcctggtaaatctttcggctgagacgtttgtcatagaagatggggagcgtattgcacagatggtcattgcacgccacgaacaagctgtatggaaagaagttgaggtactggacgaaacggaacgcggtgcgggtggtttcggacataccggaagaggatagatgttcggtcgaatcaataattgtaataaaatgaaaataaataaattgcttttcggaatgctgctgcttctattggcttcctgcggttcatcccgcaaggtgcagaaacaatcggagcaagttgccgttcaggaaataaatctcgctccggagcagcaacgtaaatatgactatttctttcttgaagcatcgcgcctgaaagtgaaaaaggagtatacggccgccttcgacctgttacaacattgtttggctattaatccaaccggttcggcagctctatacgagatttcccagtattatctttttcttaaacaagtgccgcaggggcaggaagcattggagaaagcagttgcttatgctcctgataattactggtatagtcaggcattggccagtctgtaccaacagcaggatcagaaagaaaaagcgatcggaatactcgaaaagatggcgacacgttttcccgctaaacaagatccgttgttcaacctgctcgatttatataatcagaaggaagactatggcaaagttatttctaccctaaaccgtatagaggaaaaaatggggaagaatgagcagattacaatggagaagtttcgtatctatctgcaaatgaaggatgacaaaaaggcttttgaagaaatagagagtctggtcaatgagtatccgatggactaccgctatcaggtgattctgggcgatgtctatatgcagaatggcaagaagcaggaagcttatgatacttataagaaagtacttgccgccgaaccggacaatccgatggcattgttttcattggcttcgtattacgagcagaccggacagaaagaactgtttgaacaacagatggatactttgctactgaaccggaaagttccttcggatacaaaggtgaatgtgatgaggcagtttatcgtccagagcgaacaggagggaaaagacagtacacaggttatcggactgtttgaccggatgatgcaaatggatatggacgacgcgcaaattccgatgctttatgcacagtatctactatccaaagggatggaggcacagtctattccggtattggagcaagtagtacagatagatcctaccaataaagctgcacgcatgactttattaggttccgccatccgaaagaatgattatgaacaggtgattaagatctgtgagccggggattgaagcaactccggatgccttggagttttatttttatctggctattgcatataatcaggccgaacgttgggacgatgtactggaagtcagcctgaaagcactggaacatgtcactccagagagtgacaagcaaatggtctccgacttctatacaattacgggtgatgtatatcataccaaaaagttgatgaaggaggcgtatgcagcgtatgattcggctttggtatacaatccgtccaatatcggtgcactaaataattatgcttattatttatcggtagagcgcagggatctcgataaggcggaggagatgagttataaaaccgtaaaagccgaaccgagcaatgctacttatctggatacttatgcctggattctttttgagaaaggaaactatgctgaggcccgtatctatattgacgatgccatcaagaataccaaaccggaagaagagagcagcgtggtgtttgaacattgcggggatatctattttatgaccggtgacgtagaaggtgccttgaaatattggaagaaagcactcgaactgggtactgaatcgaaaacacttaaacagaaaatagaaaagaagaaatacattgcggaatgaaaggatgtatgtttaagaaatctgttatcagacagtcatacctgctgcctttactacttttggtaatgctgcttgcgggttgtaaaacatcgaaggttgtcaagaccgcaccggtggaaccggcttacctttcgtctaagctgcagctgacagtgcctaacaaaaacggcagtattactgtaagtggcagtatgaaaatgaaaagtggcgaacggattcagctgtctgtcctgatgccggtgttccgttcggaagtaatgcgcatggaggtcactccggatgaagtattgctgatagaccgtatgaataaacgttatgtacgggcaacccgtgatgaactgaaagagttattgcctgagaatgccgatttcgaccggttagagaaacttttgttcaaggcttcccttccgggagagaagaaagagcttacaggacgtgaactggggattccttctttggagaaagccaaagtgagactgtctgatttttcgaccgccgaacttgaattaatccccaccgaggtatcatccagatatactcaggtggcattggaagacttgctaaaaatgctgatgaaactatgaaccgctttcttttgattctggtaagctgtctttgtttgacaactgttgtttcagctcagtccaataaactgattaaggagctggagagtaagcgtggtgccttgcaacaacagattgcggagactgagtcattgctgaagaatacgaagaaagatgtaggcagccagttgaacggacttgccgcccttaccggacagatagaggagagaaagcgctatatcattgccatgaacaatgacgtagaggctgtcggtagagaaatctccggattggagcgtcagctcagagggcttcagcgtgacttaaaagataaaaagaagaaatatgagtcatccgtacagtacttgtataagaataaatcggttgaagagaaactgatgtttattttttctgcgaaaagccttggacagacttatcggcgcctccgttatgtgagagaatatgccacttatcaacgtctgcagggagaagagatcttgaagaaacaggaacaggtgaaccgtaagaagaaagaacttcagcaggtgaaagccgctaaagaaaacttgttgcgtgaacgggagggcgaaaaggctaaactggaagcacaggagaaagagaaacgtgagatggtggccagccttcagaagaaacagaaggggctgcaaagcgaaattaataaaaaacggcgtgaggctaaccaactgaatgcaaaaatcgacaagctgatcgcagaagagatagagcgtgcccgcaagcgtgccgaagaagaagctcgccgggaagcagccgcccgccggaaagcggctgccaaagaggacaagacctcctcaacgggaagcggcactgctccggcaaagaaaaaggcggcgcctctggaacgtttcactatgagtaaggccgaccgggaactttcgggtaatttcgtgagcaaccgtggcaaactgccgatgcctatcacaggtccttacatcattaccagccattacggacaatatgccgtggaagggttacgtaatgtgaaactcgataataaaggaattgatatacaaggcaagccgggtgcacaggcacgtgctatcttcgatggtaaagtagcagccgtgttccagttgaacgggctttttaatgtactgatacgtcacggggattacatttcggtatattgtaacctctcgtctgcttctgtgaaatccggtgatacggtaaccaccaagcaggctatcggtccgattttctcagatggcagtgacaatgggcggactgtccttcatttccaattgcgcagagagagggataagttgaaccccgaaccgtggttgaaccggtgacgctttcattgggtaaataggcacatacaataacaacaagtcgttttttaaatcttaaatgaatacaacacatgcgaatcatcactctactaattactttatttgcttttgggataacaccgttacaggcattctcctatttctcttttaagaagtatcaggtagaagacggattatcacataacacagtctggtgtgccatgcaagacagctatggctttatctggctgggcacgagcgacgggttaaattgttatgacgggcgaggcaacaaggtttacagaaatatcctgaatgataaattttcgttagagaataactttgtgcaggcgctttttgaggaagagaaccagaacatttgggtcggaaccaattggggactttatatctatgaccgggaacatgatcgtttcaccaatttcgacaagaaaacccggtatggagtctttatcagcagtgagattaagaaaattataaagaccgagagcggattaatctggattgccactctggggcagggattgtttgtctatgatcccaagaccgatgtgttgacacaaaacagccttcagacttcttttatatgggatgtctgtgaaagtaactcccgccacatttatgcttcttccttacaagaaggtctgctttgtttcgatgagaacggcaaatttctgcaatcttatcctcttatatccgtggggaataatcccgataattaccgtattaactgtttacttgatattcgcagcgatatctggttcggagccggaagcaatctgctgtattgtctgaacgagcgcaccggaaaattggactgttataatgcttcccatctgaattttggtgttattcgttgtctgttaagttattcggaaatagaacttctggtaggtactgacaacgggctttacctttttgatttgcgtgataagactttttcgcggatcgataacccatcagatcccagaagcttgagtgaccagtcgatcaatgcgatgatgcgtgatgcagaagggggaatttgggtgctgactaatctcggaggagtaaattatctggctaagcctaccaaaagattcgactattatcctcctgtctaccgggatgggggagtaactgccgggaaggtggtaggccctttttgtgagaatgctgccggaaatatctgggtgggtacccgcgacggtttatgcttcttcgacgtgtccactcatcagttgaccgcttatccgatcggtgggagagcggataaaaaatatgacatacgctctttgttgctggatggtgaccgtttgtggataggcacttatgccgaaggcttgaaggtactcgatctccggaccgggcatgtgaagtcgtataatcatctgcaggacaccccgaacacgatttgcagtgacgatgttttggctgtctacaaagaccgtagcggagatatttttgtcgggaccagttggggcctgtgccgttacaatcctcaggaagataacttttcaaccatcactacggtaggatcgatggtatctgtggtcgatattctggaggacatgtatgacaatttgtggattggcacgtccaacagtggggtgttccgctttaacacacggaacggacactggaaacatttccagcacgaaaggaatgattcgactaccattaccaacaattccgtgattacactgtttgaggacctgaaaggtaccatgtgggttggtacgaacggtggagggctttgttcattcgatccgaagacggagacatttgttgactttgatccggacaataccatattgcccaatcgggtcatctactccattgagcaggataagacgggcgatttctggatatcaagcaatgcgggactgataacgattaacccgatcaccaagcagcatttccgccagttcacggtcaatgacggtctgcaaggtaaccagttcactgcccagtcatccttgaagacgacaagtggcaaactctattttggcggaatcagtgggttcaattctttcgttcccgaccagttcatggataaccagtacatcccttctgtatatatcaccgaaatacgtctgccctatacgacagatgaacgggtggtacaggatattcttcatctggaagagcctctttatcgtgccaagaccattacgttgccttacgaatataatactttctcggttagcttcgttgccttgagttatgaagatccgttgaagaaccgttattcctaccgcttgaaaggggtggacaaagagtgggtagtcaattcagaactgaatacggcttcttacactaatttgcctccgggtaaatatgttttcgaagtaagaggttcgaataatgatcataggtggaacgatcagactacctctcttctgattgtaatcacgcctccatggtggctgactacatgggcatactgcatctatacgcttcttctgatcggacttgcctattatgcaggctggcgatggaaccgatatgtgaagaagaagtacaaacaccggatggaagagtatcagactgcaaaggagaaagaagtctataaatcaaagattagtttctttatcaatctggtacacgagatccgtaccccgttgagcctgatccgtcttcctcttgaaaaattgctggaggataagcgggaaggacgggatgccaagtacctgtcggtgatcgaccggaatgttaactaccttttgggggtcaccaatcaactgctcgattttcagaagatggagaacggcggagtgcagttgaatttgaagaagtgcgatatcaatcagttggtaagcgatgttcatgggcaattcacaagtcctgccgaactgaaaggcatctcggtggtgcttgatctgccggaaggtgagatttttgcctcggtggatcgcgaaaaggtctgcaagattattgtcaacctgataggtaatgcggtgaaatatgcccaaagccgtatcgatattaaattggtatcttccggtgagggttttcgggtttcggtgagtgatgatggtccgggtattccggatgctgagaagcagaaagtctttgaggccttctatcaggtaaaggacggtaaatcgggtgcggttggcacaggcatcggactggccttctccaagtcattggctgaagcccatcatggtaccttaagtctcgaggacagcgtatatggcggttcttctttcgtgctcactttgccttggggcgaggaggtggtttctgaagagcccgaggtgctgatgccggaaagccagaatccgattgcccaagaatcagtcggtgaggtgccgggcagtaagtttaccattctgttggtagaagataacgtagatctgttgaatctgacgcgtgagtcgctgagcacttggttcaaagttctgaaagctcaaaacggccgtcaggcgcttgaagtgcttgcacatgaaacagtggatgtgattgtcagcgacgtgatgatgcctgagatgaatggtttggagttgacggcgaaagtcaagacggatgttgaatactctcatattcctgtcatcctgctgacagcaaaaactacgttggaagctaaagtagaaggttttgagtatggggcggacgtgtatatcgaaaagccgttctccatccgccaattacacaaacagatagaaaacttgttgaagttgcgtcagtcgtttcataaaatgatgaccgaattgtccggtaacagtggaacttcgcctgtcagtccggtggaatattccgtttcgcagaaagattgcgaactgatggctaaagtgcgggcagctgtcgaggcacagctctcggatgaaaatttctctgtcgacacattggccgagtcactcaatatgagccgttccaacttctatcgcaagataaaggcactggccggcatgccgcccaatgactatctgaagacgattcgtctgaacaaggctgccgagttattgaaaaacggggtacgcattaccgatgtgtgtgagcagattggtttcagttcttcgtcttattttgctaaatgctttaagattcagtttggagtgttacccaaagattatcattgatatcttctgtgatgaatactattttacgaaaatatttgctgaaagatggcttggtccggcctttcggagccttcccggagaggggaggatttatgtgtacgcgtggtaagtctgcgcatatacgcagatttattttcgtctatgcgtaaatccgaatcctccagaaaggtgctttagggcgttttggagagagaaagactgatcggggcggagcggggagtagcggtaccccctgttccgcttttatagatagaagtcgggatgattcttaatttttataaattaaatatcggccggagaggtgtcttttacttctcactgatcccttctttgcaaggttttcccaaaacaggcattccatcggcatcccagcttattttttgcaggcgggggctgcgtgagtctgttgcacccggagcatcattcgggattcttcgggcatgataaagcatataccactcctttccgtccggcgaaggtacgaaagaagggctgcccggtccgaagacactatcttcgggttgttgttcaaagacaggcgtgtccagcttcttccacgatgcggcgtctgtcaggtcgctgccggcatcggcactcagccgtccgatgcagtaataaggagtccaacttccgcttgcacagtagtatatcaacactttgtccttgtttttcgactcaaagaactgtggggcttcgttgacgtggatcggataggccgttttactgccgtcgggcgaaatccattgacgttcccattcatactccggttccgaaatcatcactctgtccgacgagagtgtccatggattctccatcttggctatgtagatgcattgggtttcggcctcgatccgtcgtttgggccatccgcaccagatgaggtaacgttctccccggtgctcaaacgtactggcatggattgcccagttatcgtctttgtccgttttgatccgccctttcatcacaaactcaccctccagcgggttggctgaggcattttcgatcacatagatgtggtgattatccatattgccgtcgtccgcggcgaagtatacgtaccattttccgtcaatccggtgtatttcaggtccccaaaggtgatacgaactggacatttccttcggtatccacacctcttttcgggttgcatgttccagatcggtgatatcattcgtttcccaaaggatgattttattctcggctccttgtgtatagtaatatttgccttcgtgaaaaacagcccatggttctgctcccacgggcagtagggggttggtataggtgactccggaagggacctccttggatacgggagcttttttgttttgacaagccggacagcagatgagtgccagcaagagcaatgggatatgtatgagtttcataggcttggggtttacaacaacgttacaaatatagataccttttgagggggctgaaggcggagaggggcaagtttaggctattttaacgtgaatcggtcgaccacgcggagggcacagagttccacagggaatctatttcttagttaaacaagagattaaaactttgtggaactctgtggtgggccgatggcgtcagagctcgctgatttccgaatacagctcaatcatgcaggagttttccagcaagcttttgaacttgtctttacggttgcccgaccagtcattgttcagcaatccgttttcgtcacgggtatactgccaggcatagtccgcattgtctatcatggctttcacgtaagtatcatctttatcaacctcgtaaagagctttcaagccgcggaagaggatgacgttgaaccacggacttgacggaaagaacttcatttccccttttaccgtaggctgcggtttcaggaaatgccggcaggtacctttggccgtctgctgtgcgtctttcaggtactgttcgtcgccggtagcctgatagagcagtacgcctgcttggatcatctgtccgctgttgtacgtatatttggcataaccgatttttccttgcagatttttattgtcccagtagacaaaatcagacgggtcacggaggttatcacgtgtccactggtaagttgccttggcttggtcgaggtattttttctccttggtcagcttgtagagcttcatgcagagaactgttgcaggagcattcgaacaagtattctttgattcctttttctgttcgcaccagtagataccgcctcccagatcatccgaccatccggaatagatgtaatcgtgcaaggcaatggccttcttcaggtattccttattctttgtggctgcataatagtcgcagaagtcaatcgccacccaatcattgtcgtcgtagtaacggtcattctggccggcaaaggcgggataagactgataacactccggttggcgggtagtatcccagtacaagtcgagtccgggcttgatctgcttgtccatcagtttcttgtactttttgtcgccggatgttttatagagcgatacacagcctgacaccattgccgaataaggccacaggaaagatacttcttgttgggtaacttctgagccggtgttggctgtatacgtgatctgttgattcggattttgtggataagtttccatcagcaatccatacttttttacctcatagagagacagtacccgttggaggagtgaatcggctctctgaaggtagattttacctcccaactgtgccgataaacaggcaggaaccagcaagaaggtgagggcaatgaatgattttctcatatttatattcaaataatggcgatcggtggttgggcaggtggcacggcgttcacaggggttaatccggtgagcgggctgtgcgacttgacaataactcaactactgattcgcataaacagtaaaattgtagattacagtcgagagcttcccgggtgcaagagccttttcaccacaggttacacaggttattcatgtagatcattcgtgacttagaaatcactctgtgttaccctgtgttctctgtggtgagttttgacatatttccgggcgcaaatctcccttctttactttattttctcaaaaatagctttgatccgtttcatatccaatttcggagtacggtcataatagtagataccgttcttctcctgttccacgtcggtcagctgtgtatagcagaatcccgtcacgtgcggtgagtcgataaaagcattgatctgaccttccaggcgtttgtagaatgcttctgcattttccggcataccaccgtatccccatgagtttttacggtctttctcagccatccaggggatacctccgaattcgtcaaccatgtaaggttgtccctcgtaaacggccaggaagtctttgtcacgcgcattgcggtaaggctctttgccttcttccatttttagctgttcagtcagtttggcacgatcctgttcgtagttgtgtacgctccagatatctgttatcacatggttatcaccactggcgtcgtttaccggacgagtcgggtcgatagctttggtaatgttgtatacgtcacgtaccagacggacataagcatctggaccgccaccccaagtttcattgaaaggagtccaggttacgagtgagggatgattgcggtcacgaaccactacttcactccattcacccaggaagttgcgtgcagccagctccttgtttacatccagcatccagcttgccgattctccccaagtgatgtagcctaacttgtcggcccagtaataatatctctcttcaaatactttctggtgaagacgtgccccgttgaaaccggcttcttttcccagtacgatgtcattcttcaggtcttcatcgctcggagctgtccagataccttccggatagaatccctgatcgagtaccagacgctggaaataaggccggttatttaggtagaaacgtccgttggctgtgtgcactttgcgcataccggcgtatgatttcacttcgtccagtacgttgcctttagcgtcctttacctgataaatgagatcgtacaagaacggatcttccggcgaccatagcttcatattcttcaccggcagaactactaccgaactgttggcacaatttacacttttcttggcaacggttttatttccgtctttcaaagtgatttccaatgtgttggccgattcattataaaattccggttcgatgaccaactgtttctggtcgatgtccgggcgtacgaataccgacttcagaccgtcggctgagacagcttccatccatacagtctgccagataccggtagtacgggtataagagcagcctcccgaataatagttaccgcattgctttcctccggtctgtagtccggaacggagatcatcttgtacgaataccaccagattgtgagtctttccgggtactacatagcgagtcaggtctacggcaaacgaagacgaaccgccaaaatgacgttgtacgaatttactgtcgatgtagatctccgcacaatagtccacagcaccgaagttcaggaatatcttttttccattccagtccgatgggacggtaatattgcgttgataccacatctgttcgatgaaatcggtatagcctactcccgaaagtttactttccgggcagaagggtacagtgatgtttttatcaaacttctctgccgactgcaggcggcggtcttttcctgatttaccaaaatcgaaatcgaatgtccaggtcccgttcaggtttacccattgttcccgttcgaactgtggacggggatactccgctcgcggagtatctgcactgaaacaggaccagctgttcagcatgaatagcattgctgctgctaaaagttttttcattgtaattgtgtgtttgggtccttctttcccctccacttgcaggcaggggagaaaggaggacttgtgtatgaatattgagtttattattataatggttcggagtgcttattcacctctctattggggagaggctcccactaccggaaattccgttattcttaatgtagtgcatccataaggaatcagggtgatttctgtttccggcccttcgcctccgctacagaaagaataaggttgaggccctgccatttcgttgtaaagtttccatgaaggtaccaaccttgctttcatccgtatttctatcggagcattttccttattccaagggaatacggaagattgcttttccgtatgaatcgttacacgggcatgttcgttcgcttggttacggttgaaatcaaccaatccgtagttccatggttcggttggagtcactgcataataatacggaccataccacggctcttcaaactctttcttttcccatttttcttccatcttcaaggcaaataccaacggaccgcgttcaatggttaccgagttttcataccaagtgctggcagtgacttccatcggcagatgaagttctacccggtctccttttttccagttgcggttgacaatggccatccggcctccttcgacatgttgaagaagttgtccgttgactgatattccggcttgtttgcaccatttcgggatacgtaattggagagcgaagtttacttctttccgttttttatccattgattgaagggagaaactgattttgtcatccatcggataataggtttcttcactgaaagttaccgtacacccgtccgctactttggccgtcacttccgatggagcgtatgccgtaacagccagtccgccgtcaggagtggcataccagaggttttgggtgaatttaggccatccttggtgcatgttcgatgcgcaacaaggatatcctgtcaatagtccgaaacagttgtccgttcctccatgatcctgatcgaagttgcggcggtggcgtgtcaccatcacctgattggcttgctggaaatattgtttcgtcatgaaatcgtcagaaatttgggtaggcagtgcattgaatgcaatccgttccagatggtcggcgaaatcgatatcacctgtgatctctaccattttctccagcgaatacatcagttccactgccgaacaaagttcggaaccctgagttggattattaccatgcaaagcttcgtcaccgccatacataccctgaggttgtccgtgaaactggcgaatatcactgaaagcacgtttcactgcatcaagatatgctttgtccggttcttgttgataatagatgacaggttctttgatgccttgcgccaggttgacgcaatgaattgtgttgatgcgtctcagatcaccccggttcaccatgtctacaaaactaaaactctgtttatggatcagtttgccaagatcaaggaggaacgaatctccggtgatattataaagccaatacactgcctgaagattgtcacaagcacggaattctgcccagaaggtccagttgcccagtggtttttccggtaaagttttcagttggtagcggaaatagttggtcatgaacctgataacccgctggtcattggtggcggaataatattgttgaagtatctttaacattaccatgcgtggccaccagtcgtgtgagttgtcccgttgtatgccggcctctcccggatagtctttggccggaccgaagaaaccgtcttcccgttgactttttaaagcccattctatccagggttgcactttagctttcagctgtgcatcgtccaggatatatgccagtggaagtaatccgtcaatccagtatggtcctctttcccattgatcaccgtcaccgccgagccagccgttgcgttcgcccatcactaacggatacagtttgtccatttgcccggttgccccgtttttctgcctgaccagcatttcctgcagccatcctttagctttgatactgcccaatggcagttccataaaaggtttgcgcaccagtggataacggttgttggtatagttctcgggggtatcggcccggagcccacttcccaaggaagagaagcagaggcccagtccgatgagcagatatgtaaatgtattttttttcttcatgagtgtctttcgattaatgctttatcaccgggtatcttttattctcttgtgttcgggaaagccgaaacccgcagtctggctgctcccatcggaatcagggtgatttcttctttttcccctttcggagcgtccatttcaggaagttcgctacacaagtcgtattgatcgataacccatgaaggaaccttgcgtccgatagcttttacctcgataggtgtacttgcgaccgtgaacgggaagttgtcagccggccattctttgtgtactactttaaagtctttcaaaggttcgttcttaccgagtaccaatgcgtagttccaaggagtttttgcatagatctcgtatgtcggccattggctggcgtcagcgccttcctgccatttagagtcaccgatagccgtagcgcggctgtcctttttcacataatcttcgtcaattatcagtgacattgtcaacggaccgtagtctacgcttacactgtttttgttcacttgccatgtacgcatcgaaagttgcatcggcagctgaatttccacttggtcattgtctttccattcgcgatggatgcaggcatattgtccggcttcggggctggccgctacctttttgccgttaacaaagatagtcgcaccctctgtccatgaaggaattctcaggtagaaggggaaacttactgctttcggagtatttaccgtaaaccggatcgtttcctcaaaaggatagttagtctgttcgtgaagagttatttcgtttccgtcacccactttcactgttgctttgcaggcagcatacatagcggctgctataccgttatccggactggccagaatcagatgttcggcatagtaaggccatccctgtgcatgattgtgctggcagcaacggctactgaagggattcattgccaggaaaggtccccggttgtcgatgcccggatgatggttctttgagtcactgacagtttgattgggacaagtgatataacgcaaacccttgaagtccggcattacggcagccggataactgttgaatgccacctcttcgcagtgttctgcccaaaaaggatcgccggtcatacacagcatcaactcgtccgaggccatctgttccaccaatccgcaggtttctactccctggcgcgggtcaattgatcccatacgtgcattttcatcggcaccgaacataccgcccggcacttgtccgaaagtacggcggatcaggttgtgcacattataagatgctttcagcagggtcgagtctcccgtcatcatataataggtagccggttcgcggaaacattgtgcgatgtttacattgtgccagttcggcagtgccgacgggcgggtccagtctgctgtgttccggtgtatcttctcagccagttccagtaagaactgatctcctgtgcggttataaagccaatatacgcttaacaggttatctccgccacggctgttttcccaatagtcctccaggaattgttcgtccggtacacttaactgccatttaaagtaattggtcatcaggtcgattacccgttggtcatttgaatattcataataggattgcagacaccagagcataatcatctgtgcccataattctctttttccgttccgctcgttgatgggaccaaagtatccgtcgggttgttggctggcgaatgctccttcgagccatactttagcttcatcaatcattttctgatcctttaatatataagccaggtttccgtatcctttcagccaataggggacttcttcccatccgtgatctcctcctttggtcagccaggcattattctctttgcccagccatgcactgatttcattcaggtgaccggtcagaccgtctttctgtaattcgagatatttcttcaaccatccttcgggctgaatacttccgacgggtagtttaatgaagttcatcggtttcagtggcaggcggtttcctacatagtttgcgttggtttgtgcacagtcggggcgattcactatagttacttccgacgatgattgatcggaagtacacgatgctgccagtaatccggctgtaaataggattccggccaagcctcctttcagacttttcatctttttcatgtttgggtgtttttacttatggttattatttaggggttatttcaatacaaatcagtagcttcatctgatatcatgctacaaagtttgtgaattctgtatgaaatgtgcgacacaaactattcaataaatagcaattactgaccaatacgatgcgaaatgcgggttatgtgaatattagaagtataaaaagaacagattcttttgtttattgagcagtatttatccctttattcaacgaaaatgttttttctttgtagcatcttaataacagaaagctatgaaaacaaagatctacctgctatttattactaccttattcttctgcgccggttgtggaaacaagagcggcggacagaaacaggagtcggtaagtgcggcaaaggatacatatgtaaatcctttgtttccggaaggggccgatccgagtgctcttttccataatggtaagtattattatactcatggaacggaagataagatcatgctttgggaaacgtccgatattactgatatggcccattcggtttgcaaaatagtgtggcaacctcaggatccatccaacagttgtcatctctgggcaccggagattcactatatcaatgataaatggtatatatattatgcagccgatgacggcaatacggacaaccatcagttgtacgtacttgaaaactcttctcccgatcccatgcagggtaaatttgaaatgaaggggagcattatgaccaatcccgaatggaactgggggatacaggccactactttcgaacataagggagttcgttatttagcttggtccggttggcccaagaggagaaccaatgctgaaactcaatgtatctatattgcccggatgaaagatccgtggacactcgattcaccccgtgtcctgatatccaaacccgagtatgaatgggaacggcagtgggttaatccggatggcagccgtacggcttaccccatttatgtgaatgaagggcctcagttcttccattcgaaagataataagacgttgatactctattatgccgccagcggttcgtggtcaccctattactgtatcgggatgttgactgccgatgccgagagtgatttgctcgatccggcttcctggacaaagagttcggttccggtatttcagcaatcattggagaatgaagtttatggtccgggtggtctctcgtttgttccctcgcccgatgggacggagtggtatatgatttaccatgcccgtcaggtgaccaatggagacaccgggagtcctgaaacccgtaatccgcgaatacaaaaaatagaatgggatgcccatggaatgcctgatttagggattccggttcgtgcaggggttgccttgccgaaaccttcgggtactcctttgaaataaaatagtcatttagaacattttttcctcattctgacaggtagccgcctacctgtcccggggatcatattgcatcattaataggttaaacataatttgaagacaatgaaaaagagcattttaattgcagttctgacagcgtcgatagctacttccgcttttgcacaatggaaaccggcaggagacaaaatcaagacaaagtgggctgagcaggtgaatcctgaaaatgtattgcccgagtatccacgtccggtgatggaacggggagagtggaagaatctgaatggtttgtggaattatgccatcaccgagaaaggagctgctccttcagcttacgaaggtcagattctggttccttttgccatagagtccagcctttcgggtgttggtaagaaagtcggccccgacaaagaactctggtatcagcgtactttcacagtacccgcttcctggaaaggtaaaaaagtgatgctgaacttcggtgctgtagactggaaagctgatatttgggtcaatgacattaaggtgggacaacacaccggaggatttactcctttttcactcgatattacggctgctttggctactaaaggagacaataaacttgttgtgaaggtatgggacccgacagatcgcggacctcagcctcgcggcaaacaggtaaaccgtccggaaggcatctggtatacggctgttaccggtatctggcaaactgtctggatggagcctgtgtccgaacgtcatattactaatatccgtacggcttcggacatcgaccgtaagagactcacagtggacgttgctaccagtaccaactgtccttcggaagttgtcgaggtaaaggtcttcgatggtaaacagctggttgctaccggaaaaggattgaacggccagactattgacattcagatgcctgctgatgccaaactgtggagtcctgcttctccgactctttattctatgcagattgccctgttgagcaacggtaaagtgaccgataaagtagatagctatacagctatgcgtaaatattctacccgccgtgataagaacgggattgtacgcctgcaactgaataatgaagatgtgttccagttcggtccgctcgatcaaggatggtggcccgacggattgtatacagctccgacagacgaggcattggtgtatgacatccagaaaaccaaagatttcggattcaatatgatccgtaagcatgtgaaggtggaaccggcacgttggtatacacactgcgataaactgggtatcattgtatggcaggatatgccgaacggcgaccgtgaaccggagtggcagatgtataattacttcacgggtaacgagctgaaccgtagtgaagagtcggaacatatttatcgtaaagagtggaaagagatcatggattatctgtacaactatccttgcatcggtgtatgggttccgttcaacgagcgttggggacagttcaagaccgaagatattgcggcatggacaaagaagtatgatccttcacgcttggtgaacccggcaagtggcggcaatcacttcccttgcggtgatattcttgacctgcatcattaccccaatccgtcactcgacttctacgatgccggacgtgctaccgtgttgggtgaatatggcggcatcggcctggcactgaatgaacatctttgggaaccgaaccacaactggggatacgtgaagttcaattcacccgaagaagtaaccaaacaatacgttgaatacggcaatgaattgtaccggttgattcagcgaggtttctcggctgctgtctacacacagaccactgatgtggaaatggaagtgaacggactgatgacatatgaccgtaaggtgattaaggtgaatgaagcccaggtgaaggctatcaataccaagatatgcaattctttaaataagtgattagagtagggtgtcgataggtacacaagtttttgattaaggtatagattgttgaaggatacgattttgagtgaaacatacaaataaataaaataatgaaaaaactatttgcaatggctttagcagtcggtatgctatgtaatgcacaggcagccgatttgtacaaagcgagtaaaaatgtagctttgcgtgctccggcagtgcctctcatcacttccgacccttatctgtccatctggtcgcccacagatgcactgaatgaaagcagcacgatgcattggaccggaacggaacatcctttgttgggtgccatacgtgtggatgggaaaacctatcgttttatgggcaaagataagttgaaccttgagactcttgttccgatgacggataccgatacctggcagggaagttatacttttgaccagccggctgcgggatggaataccctttcgttcaatgctgccggatggaaagagggacaaggtgctttcggtactcccgatatgcctcgtgtccagactcgctggactactccggatatctgggttcgtcgtgaatttcagatcaatgacgacctgaacggagaaaccatctatctgaaatattcgcacgacgatgtattcgaactctacctgaatggtgaaaagctggttgctacggactattcatggaacaacgacgtattactcgaactatcggacgcagccaagaagaagctgcaaaaaggaaaaaacgtacttgccgcacactgtcacaacacaacaggaggtgcttatgtagatttcggcctttatcgcctgaacaaacagacgacgggctttgagacggcagccgtccagaaatcggtaagcgtactccccacacaaacttactacacgtttacttgcggtccggtggaactggacctggtgtttaccgcacctttgatgatggacgacctcgatttgttgtctactcccgttaattatatttcttaccgcgttcgttcgctggataaaaaacagcacgatgtgcagatgtacgtggagaccactccacagcttgccatcaatgaactgacacaacctacccgttcgaaagtgatccgtcgtaacggtatcaattacgtacaggcgggaaccatcgatcagcctatcctcggacgaaaaggagatggaatctgcattgactggggatatgcttatctggccggaaatataggtgccaatacggctgtaagcctgggtaactattatggcatgaagaacgaatttgcgactaagggtactttattgcccacgcaagccgaatgcgtgacccgtcgtgccgaccagatgccggctatggcctataccgataacctgggcaaagtaggtgccgatggcaaatccggcttcctgatgttgggatatgatgatatctcagctattgaatacttctaccagcctcgtatggcttactggaaacatgacggtaaagtgactatctttgatgccttcgaacgtgccaaagccaattatgcatctgttatggaacgctgtcgcgcttacgaccaaatgattctgaacgatgcagaaaaagcaggtggcaaagaatactctgaactgtgtgcgctcgcttaccgccaagtgattgccgcccataagctgttcaaggatgcggatggtaacttgctcttcttctctaaagagaacaatagtaacggttgtatcaataccgtcgaccttacctatccgtctgcccctctcttcctggcttataaccccgaattgcagaagggtatgatgaccagtatttttgaatacagtgccagcggacgttggaacaaacctttcccggctcatgacataggtacatatcctattgcgaacggacaggtttacggaggagatatgccgattgaagagggtggaaatatggtggtcctgactgctgctattgccaaagtagaaggaaatgccgattacgccaagaagtattgggatttactgactatctggacggattatttggtagaatacggacaagatcccgaaaatcaactttgtaccgatgactttgccgggcactgggcacacaatgccaatctttcggtaaaagccatcatgggagtagccggttatagcgaaatggcccgtatgctcggtatggatgatgtagccgaccggtatgccgctaaagccaaagccatggccaccaaatgggaacaaatggcacgcgaaggcgatcattaccgtctggctttcgaccgtgagaatacctggagtcagaaatacaatatgatttgggacaaaatgtggaatctgcacctcttccccaacaatgtgatggagaaagaagtcgcttactatctgaccaaacaaaatctttatggtctcccgttggattcccgcaaagaatatactaagtctgactggattatgtggagtgctgctatgtcttcggacaaagcgacttttgaaaagttcatttctcccgtatataagtatgccaacgaaaccgtatcacgcgttccgctgagtgactggcattataccgatagtggtaaatttgtcggtttcaaggcacgctctgtaatcggtggttattggatgaaggtattgatggataaaatgcagaaataataagaaccggtatataatagagtttactgttaagggttgtatccaaagcttgttcagcttggatacaaccctttcttaatttccctatagaagatactgcgctggctgttctacttaagccggtgccgatttaagtaaagattggttgttaagggtgttctggtatctctgtaacccggaagtccgtaccaattaaaccctcttccgaatggccttcacaatggatcacgtattctccgtcttcctgatcgtttaaaaagaaagatatttgtgctttaccttctttgtcggtttttacagtaggattccagtacagtgtatttctttgttccgaatgttcgaagaatgaatgatcggaaagagtcggagtataaaattcttttgtctggttataacctatccactggcagattttattattcgttgctataacttctccttgtatcggacggctatataatacgatagtacctccatagtttctaaatcctccgaactgagtggacgtctgttgcaggacttctacccgttcgattctggatgcctccatgctatacactacttcaggatctttggcaatatacccatccagtaccaaggcagctactgttcctccgggaagtccgttgatgtgagcatactgtaaattactctttgttttatccggattaggaaccatggtgatgccgggcactgttctcagtaattgacggacatctccaaaactgttgcttgctttcacttgagtacttgttttcacgaatccttcactataaggacgccgcttttcaatcggatctttttttcgtgcggttactttcacttctcctaattcgaatagctgtttgtcaatttccttttgggggatgtaggacttggtaatatcccattgtacatgaaaagaactatcaggtgcaaaaggagaaggcatatatttcaccgatggaaccggaatggaatcatcaagtttgatcggataggttttcccattcttgtcggtggctgagagcatgacttcctttgttccttcaaaagagattcccgataggctgaaacgtttttgtccatccaacggacaggtaataaattgtttgagtgaatcttgacgtaggatagcctgaagctcaacagatttagccttctgtttatttatattttccacttttcctgataaggtgagagattgttccataggatatcgggggagattatcgggctggttgaaagcttcaagtgagtagcgtcgccatccttgtgtcagcaatagcagttctattttagacaggctttcagtatcttccggattccagtagcttaatggttgttccgtttgccctttcaggttgctactaagaaataagtaggtactgaagttgtcacggatcgttggttgctctaaaaaagtttgtgcgactgccagcgagaaagaacccggttggggaattcctttcttatcagtactacggatattcaccgacatttttcgatgtccttcttgtaccgaaatagtagatgaaagttttaggttgagtgtttcgggaaagtgagtaaataccagcctttcacaataggcatgatagtcttcatcgatcagggttagtgtgaagacacccgtaggaagtttatctaaaggcaaatcgaaaagtgtacgcggttgcgaaccatcgacgggtagtatggcaatcaaccgtccttcttgatggaggataagtgaataaaccgagtttttggttgaagggccaatattttgagtcaataagatacgtaatgcttctttcaggtgtttaacagtgattacaaacccctgctcgcttatcgaaggtattttaaagtctgtgttatctcctgctagacgggcaatgtatttttcttttttctgtgggatgaaaaaaaaacttcctttacccaagtgattggtagcaaatttacggatactgtctccgtgggcattcagtatgaccccttctgtttgaaccccttttccggtgttggcatccactacttcgaatgctattcgggaggtgagttcattgatcagatttcctccttccgggaagaatctcagtttaaattttgttgtctgctggggtattttgtctttctctgaatctccataaatcgttagttcacgatggaagaaaaactccggatcaaaattctgcatccatcgggtataggcacgaagttgataatggccggcgtgtagatgttctgggatcgaaaggctaccggaggctgctccgtctgccaaaggatacttgacttgttttacaatatctcctttactatttgacagatctatgtatacaatcctgctggcttcggttgctggggcagagagtgtttgatacactttaaaccaaatggtttctcctgcataatagttggtacggtcttgatgcagatataatttctcaatcggattttcacgggcgtattggttgaaccgggctgacaaaagagtatcgcttacggctttttgtggggctgctgcgcaatggatggtgcataccagacaaagaatggttaatgttgaatgtattttcatacgtaaatataaattatattccttatctaaagcgagctgttttaaatcattaataaattgattttgtaatgttatatcaaaatttctttgaataaaagtagaaacaactattcgctatttatatttttattcaaaggaataattagatatttttgagattatatttatcttattacagtataacaccgagtttcataccgataggatatatcactcatgtcagcacttatatttgttgcttctacactaataataaatttgtctgttgaaaagtatgggatatcgacatagttactataattcgaaggtgtgtatatctctatataagtttttgttccggattgccaatcaattcttacacgttcaacagacggatggagacgaatgcgaaaggaataaaattgatttgaaaaatctccaatctctacagcttttattagtccactcccagattggtagactaggtttaaagatactgcattaatctccagattgttctcaatcagtgaagatgctttggtgttaaagataaagcaactgattaataaaatgatgagatgaatttttttcataatagtaataatttaaaagttaaaaataggacattggttttctttataaacttttctaatatatagaaaaaatgattctggaaatatttagttcagagttatttaatattaaataactctgaactaaataaacatagctgttatttataaacttccagttcgtaaatacgtgtatctctgcctccggtgctttgtgtaggacgagtcacaagcagacggatgtaacgtacttttccgtcatagttcagcggacgtgaaatgacatttgcatgattaccgtcgatagcatccagagtagtccattcgtcactctgattcattttcccttgcaggaagcaaccattggtgatgtatgagtgactttcctgtccggcgttcaccatcttccaaccactgatgttttgtgcttcacccagatcgaagtctacgtagttcggagtctgcgaaacgtcacaccacttcgtatccgttttaccatccagcaggaagtccggtttttcttcatcgttggtgtatccggagcaagcaatgattttagctcctttcaggatattttcgtgtactgcttctttatcatttccggcagtagctgcattgcctacgttattagtgcggaaaagagtgccggcaacggttgtagccggttcattttcggtaaccagggtagcagcaaacaaaaccactttctcatttcggggcaagattacgctggtagctcccttcggaatatccataccaaatttgaacatataagtgaattcataaggctgatcaccgttggatgcatggcggtgtgtacctacataggcaatctcagcatctttcagatatccttcggtgtgtcctttatgtccccattggccgatgaagccggtataagaaggtacaacgaatgaagcggtctgcttgccaatgcggaagtcggcctgattgtctccttcggtagaggcggcgaggatatagagacggttgtatttgtttcccgcaggcagttgcaaggtatcaccttcacaagtcattccgttcgcaatctctttttctcccaagcggaaagtgatctgaccggctatcagtgagtccggcagaagttcggctgcaaaagaatagcccgattcgaagtcgctttctccacggaattcattataagaagcacatttgcggtcgtagtcaagcggtaaagcggcatattcgatcggagacgcctcacgtcccgatggtttgaggcgtactttgtaagttcttacagaataaggagtgatgtttacctgcaacttgtttccttcgaaagttgcattgccgattgtcttttctgtaccgttggcttcgctggcactgatgatttcccctgcaaaggtcagtgtggcgctctgtgctttccggccttcggtttcgtatacgcgtactacatactcatcggtttcttccgctttcttcagtgccttgatcaatacattgcggttgtccgaagcgacaaacgagaacgattttccggcatttcctttgtgcttttccgtacggaaggctttcagttgctggttcagcttttcggctttctctacagtggcaggtttatccaaggctccctgatgtggtatcaggctgtaggtgaaggtatgatgaccgaaatcctgatgatcctgatatgcgtaacctccgcgtgtttccggtgtgtggagcagggtgagacggatcgtatggttatccggcttgtcccatccatatttgctgtcgttcatcaccgatacaccataacttccgtcacgatcggtcaggtcggcccaatattgtgcatatacttcgtaagctgtttcggtattgttgccacgttgtatgctgccgatacccaagtcgtacgtagccttttcgttttcaatattgagcgggaattcggcttttaacaatgcgttggtcgattgccagtctatttcgttatagaagtcgatgcgttctgcacggctaccttcatacagacgtatgtattgacggaagacagattcttcgtgacgtttctcgacacaaagcgatttacgtaaagttccgtcttcaaccaaagttattttcacgtcattcgtaatcgaaaccggagtacggtcggttgtctctttcaacacttcccatgccggccaattgtatgacttgttctgagtgaagagtgccaggcggattgctttcccggctttcaccagttctttgccgttctttttgtcagtcagagagacgatatctccgtttttatccaatgtgatcttgtacagagagttttccaaggtattgacgttcgttgagacgttgcttgcaccggttcctgatgtgcgtacgtcatataccacatatcctgtagccggaactgttgcttctaccaggatgcgtgcctttccgtcggtataagaaatgagctgggccgatacttttttgcccttttcatcgtacaccgttatccctttgggagctttcggaaggtcaagttctatttccgcaatatctgtaaccgcaaatccgagtgcattataaaggattaccggaataccgctgacccgtgtatccaattccctgccgataccatgaatggaagaagtcagtacattggagaactgtttcagtgagatcagttcgtcattccatgaaaattcataggcacgcggtatactggttcctgtcaggtcatcgtggaactgatgataaatgaagcgtttccatgcttcattgatggtgcttcccggatatttggcctgattcagccattcggcagttacggcagctctttcggcagcatctcccagcaattcgttctggcggttgtacaatttcatggtagcctgtgaggtgtagcatcctgtaccgtgaacatccatcaacagttcaccgtcgaataccggtaattccggatgattcttataaggaaggtaatctttgtaaagctggtcgctggttgcactgactatttctaccggaccgtttccgcgaagccctttctccaccgagcggacagaggccagtgtcggtgatcctccgatatcgcctgtaccgtaatatctgtatactgtattaagaggtgtacggcctgccagttctttcagttgttcgttttctgaaaggtcttcgtcgttccatcttctgccataatcatatccatgtgccagcatgatagacgatccgtctattcctttccacaagccgattgtaaacggatgcttgctcttaccatagaacggatgcacacgccagtccagtttttgtgaagagaaaccaatcaggccgcagtgcgaagcgatagtaggcagtgtccagccaaatccgaaacagtcgggcaggaagatgtccgtgctttctactccgaattcttgtctgtaatactgttgtcccagcataatattgcggatgaacgattcagtcgaaggtaccagagcgtccgttgcgtcccagctacttccggaaatgtgccagcggccttccccgatgtacttcttcatttcttcgtattgtgcagggtagtactccttcatccaggcatatttcactccgccttcaaagttgaacacatagttcggatactttttcagcagaaacaggttctggctgatcgtattccaaacatactctttaatggtagtctgtacatcccagttccactgagtgtccagatgggcatctgccaccatgtaggctttcgcctttttttcctgtttattcccttgggcgtacgaggctccttcggataacagcagggtagctgccagcatagcaatgtgtaatttcatgtttgcttaatacattatttaattaataaatgaggaattatacaaaggtgaccaaattcgtagaaaggagatgaaaaatactgttcaataaatagcagaatctgttcagatgtcgttttgaggctctgtgaatagggttgaaatattgaaaaagaacagattttgttgtttattgaacgaaaattatcgtcttattagctaaatataactttcctttgcaatgtttcgaaaccgtaagagctatactatgaaatacatcccgtcttatatcccggggattatttccataacgatgcttttatacattaaagatttatagaacctgttttttaaatttatgtactatgcgtaaaaaagaacaaatgttttggctcgcaagtcgtagcagaatgtggcgcataccactttgtatggctgccttttcgcttttgccaagtgcctacagtttcgccagcgccgaaaacccggcagcagaaactgtatgggctgtgaactccgttcaacaacaacggaccgtaaagggtatagttatcgacgccaatggcgaagcggtaattggtgctaatgtaaaagagccgggaagtacgactggtaccatcaccgatattaacggtgaattctcgctgagtgttggccctaaagctacactggaagtctcatttattggttacacaacacaaaaagtaaacgtaggagcatcaaacacagttaaagttattctaaaagaagacacaaaagtactcgatgaagtcgttattaccggtttcggtatgtcacagaagaaagctactttgacaggtgccgttgctgcaattgcttctactgacatcgaacgttccaatgcaacgacagcttcaggtgcattggttggtaagattgctggtatcaatacccgtcagaatgatggacgtccgggcgcttctacacaattgcagatccgtaatatgggagctccattgtatgtaattgatggtgttgtatctgatgatggacagtttaataatatggattttaatgatatagaatctatctctatattgaaagatgcatctgctgcaatttatggtgtgcgtgctgccaatggtgtagtagtggttacatcaaagaaaggacatcgtaattctaaaaactctgtatctgttaatgcttattatggttggcaacataattcacgttatgttcagcctgctaaaactaaagactatgtgactgcttatgtctctgcagaaacttgggctaaaaaggcggacaatgatcgcaggtacaacaaagaagaatatgcgaaatggatggccggtactgagaaaaattaccagggttttgactggagcgactatatttggattactgctccccaatcgtatattagtgcgaatctttcaggaggtaccgataaggctaattattatgtagcagtttctcatatcgatcaagaagcgactgtgcgtggttatggtggattcagacgtacaaatgctcaaatgaatattgatatgaatatttctgatcgtttcaagattggtgccacgatgaatggacgtattgaagatcgtcaccatccgggtgttcctggtggagatgatacatggttgcctcgttttgctacaatgaagaatcagccgacaaagcgtccgtatgccaacgacaatcctttatacccacaacttgtttctgaccagaaagagacaaacttcgctcttttaaattatgaaaccagtggtaaggtatccgatgtatggcgtgttcttcaaatgcagacaactgccgaatatgagattctgaaaggattgaaggctaaaggtatgttgggctattattatgcttacaatgaactggataatcaggaatacacattcaaattgtatggatacaatgagaaaacgggtgagtattatgaaacagcttctatggataatccttatcgcgaacgtaatcgtgagaaggtggaggatcagtttgctaatttccagttgaactttgatcgtaggtttggtaatcattctatcaatgctgttgcttcttttgaggctacacaacgtaaacgccccaaatcatgggtacattcagttccggttgctaacggtatggatctgattcgttttaaggagattgtggagtataacgatactggtaacaatacggaagctcgtttgggatggttaggacgtatcaattatagttttgctgatcgttatctgatcgaattgattggtcgttgggatggttcttggaaatttaaaccggaaaaccgttggggcttcttcccttctgcttctttgggatggagaatatctgaagaaaatttctggaaagaaagtaagattgccaatgtattctctaatttgaagatacgtggttcatacggtgtggttggagatgataatgtgagtgattatgctgcgtttgattatctgcctggttataaatacaataacggtggcgccgtattagatggcgattgggttgttggaactgaaactcgtggcttgcctaataaaactttatcatggatggaatctaagattctggatattggtgtagatttgggcttctttaataaccgtttgaatgctcaggtagacttcttccagcgtattcgtgatggaattcctgagtctcgttatgatgtgctgattccgaatgaagcaggtttttctttacctaaagaaaatttgaaatcggacaaacatgttggttttgatgcaatggtaaactggaccgatcatatcaatgattttaactatagtgtcggtgccaatatgacttattcacgtttctgggattgggaacaatatgacacacgtcacagcaactcttgggatgtgtatcgtaacagtatttggcatcgtgtaggttacgtaaattggggatatgaggcagttggccgctttacaagttgggaacagattgctacttatccgatagataacgatagaaaaggaaacaagacagttgttccgggtgatattatgtataaggatgtcaacggtgatggtgtaatcaattatatggatgagcgtccaatcggttaccgtagtgatagtactcctacactcaactttggtattaatttgtcggcaagttggaaaggatttgacttggcaatggactggacaggttcgggtatgacttcatggcaacaacagtatgaaacggctcgtccgttccagaatgacggtaatagtccggatgaggtgtttaaagatgcttggcatttggcggatatctgggatgctgatagtcagttgattccaggaaaatatccgttaatccgtttgaataatgaagagacaagtgcttacgataagagtacattctggctgcataatgtgaaatacattaagttgcgtaatctagagtttggttatactttgcccaaacggattgttgctaaagcaggtatcagcaatttgcgtttatatgtatccggaaccaacctgttctctataagtaatataccttttatggatccggagtgcatcgattcaaatggtttggattatccgacgatgcgtgtggttaacttaggtatcaatctcaaattttaagtaaacaatgaaaaacagatattttttaatggctcttgctgctgcgggggtattatcgttgagtagctgtaatggctttctggatacgaagccaaacgacattatgacacaagatcaggtgtatgctgacccggcgttggtgaaatctgttctggctaatttttatggtcgtatcacttttggccagcgtaatgaagctgtagaagattatttcatgctggatgaggctattcattatgataacaatagtgatgaaaatatagatagaaataaatggcgtccttatgactatacattgattcgtaatttgaatcaattcttacagggtattaaaggatctactgctgtagatgaggagactaagagactttatgaaggtgaagttcgctatattcgtgcttggacttatttttgcattgcccgtgggttaggtggtattccaattgtaggagatgacgtatttgattataccggtggtatggatattactacaattcaggttccccgttctactgaagctgaaacttatgactacattattaaggagtgtcaggaagcggctgctatgatgagtaagcagactaataagaacaattctcgtgcaaactattgggtagcaaaaatgttggaagcacgtgcagcaattacagcagcttcattggctacatacaatacggtggccgaacatcctcaattgaggactgccggtggtgaagtaggtatacccgcagataaagcagagggctactatcgtacagctttagctgcggcaaaggaggttatcgaaggatctgcagatggtacggcttctccatataagttgatgttagctgctgataagacttcagaagctttagctgataacttctttaaagctgtttgtgagaaaagtggtaatactgaagttatttggacacgtgactatgctactcctggctatggtcatgaatttacaaagaattgcttacctaaaagtatcgaacaagatactggtagcgacagaatgtctgtattgttgaatttggttgaggcttatgaatcaacagatgcaacggaagcagaacgtggtaaagctgcgaaatttgatataggtacattagatgatcctaaattctttgatgatccgatggatttatttgcagaccgtgatccacgcttggcggctacagttcttttaccgggatctacttttgacggaaaattaatagaactgcaagcaggtcaattaaataaagtggatggacgatggaccgagagaacaggccgtagaaatgaaacggatgcccaaggacgattgattactgccaataatggtccgttcggaggtaatgaacgtgaaattaaccgtacaggattcttcgttcgtaaatatctggataaaacacctttggccggtactcaaggtacaaaatcggctatgtggaatgtatatttccgcatttcagaggcttatctgattgctgctgaggcttcttgggaactgagtcataataacagcgatgtagaagctttgaaatatatcaatgccgttcgtgaacgtgccggtattcagcctctaacttctatcgatcaccagaaaattatgcatgagtatcaagttgaatttgcgttcgaaggtcatcgttggtgggatttgaaacgttggatggaagctgataatatttggactggaaatgaaaatgatcgtacagcacaacgtcttggcttatggccttaccgcgtagttgcagaaggtgatgttaataatggtaagtgggtatttgtagaaaagaatatgcagacattagatttatggcgtaaaccgctgaagtgtactgatgttcagtattattcagaaatcgacaatggctggattaataataatccgaaattggttaaaaacccgtatcaataatctaaaattagaagagacaatgaaaacaatatcaaagattttttcagtattgctgttgggagcgatgatgtttaccagttgtatgaaagacaactatgacgctcctgagtcaatgttgacaggtcgtgtgatgtataatggtgaagcattgcaacttcgtggcaatgaagctgtacaattacagctttatcaacatggttatgctaaacacgatcctattaatgtgtatgttaatcaggatggtatgtattctgctaatttgtttgatggtgaatatcagatgataacaaagagtggaaatggcccttggtcttcagaaggtcgtgatactatttatgtaactgttgctggtaatacagtgcaggatgttgaagtaactccttattatctggtaagagatgcacagatgacattagaaggtaataaggtaaatgcatcttttaaagtggaaaaagttgcaggtggaggtattgaccgggtatttttcatgttaagtactactcagtttgtgaatgatgcagaacataatgtagaccgttatgatgaaactgacaatatgggtgcttacgatgaaacaggtaagctatatacttttgctacaagagattatacggataatagtatgttccaaactgctttgaaaagaggtacattgttcggtcgtatttgtatctggcctaaaggatctgatcagggtatttactctaaagtaatccgactgaaataattcatatcaatgtttaatgtgggaagggtgtcagggttcctggcaccctttctgtttaaataaattttttataaacttttaaattattgtattatgaacaaaacgattttgttagtattggcatttgtgtttgcggggataacaagtgtaatggctaatacatcgaaggatgaaaaagctgaagtaagcagtgttgataaaaaagctgctacagagtattatttggagattggcagccagagtggttccggagttttttctacgattgaattaataaatccatttgaaagaaaacttagggtagtgactcgtggacgctctacagttgagataagctttcatgaagaggggactatttatggtcgaagacttttttatactccaaatactgatggacaggttattaccgatgaaattaaatctagtgaatttaccattagtaccagttacaatgagagtagtagtagctctactattaaatatgaaactcggtattattatatcagagaaagataatttgataactggttaaaattaaagtctcctatgtttgggtttatttctgataaactgaataaggggacttttcttaatttatatattcagcatgaagaaacttttattttccctttttactgttttttctttctgtgttccttccattgcacagcagtattccaatcccgttattaattacagccttcccgaccctacggttatcaaggcagatgacggctattattacctgtatgcaacggaaaatatccggaatctccctattcaccgatcgaaagatatggtaaactggagctttgtgggtacggcttttaccaatgaaacccgccctacattcgagccgaaaggaaatctttgggcgccggatataaataaaatcggtgatcggtatgtgatgtattactccatgtctgtttggggtggagagtggacctgcgggattggtgtggctacggcagataaacctgagggaccttttaccaatcatggaaaactcttccgcagtaacgaaatagggattcagaactgtatcgatcctttctatatagaagatggtggcaagaaatatcttttttgggggagttttcatggcatttatggagccgagttgagtgatgacggactctcactgaaaggaggaatgaaaccacagcaggtggcaggcacagcctatgaaggaacttatattcacaagcggggaggttactactatttgtttgcttccatcgggcgctgttgtgaagggttaaagagtacctataccacagtggtggggcggtcaaaacacttattcggtccttacgtagataaaaaaggggcatcgatgctggagaatcatcacgaagtgctgattgataaaaatgcagcattcgtgggccccgggcataactctgaaatcgtaacagatgataaaggagcggattggatgttttatcatgctgtcagtgtagccaatcctgaaggaagagtgttgatgctcgaccgtgtaaactggaaaaaaggatggcctgttgtagagggggatacaccgtcgttgcaagcaaaagcccctgttatccggcacaaataagggggtaaacatcagtattccgctatacttctaatggtctgtataccgatatgctacgtcttattccgttatctctatctcgtcccgcatacccgggctgacgggcccgggtatgcgggctcatgggcacaggcacgcgggctcatgggcccgggtatacgggacggggtaaacatcgcaccattttcagctaagtaatagggaaaaacaaaatgctttatacggcatatttgcttagaaaactcgactttattctttgtgaatcagttctttattctgaattattctcctaaaacagtgggtggaagatggaagatacaggtggaagataaacgggctgaaaacgcgatcttccaccaagtcatcctgctgattattagaatgataatcgttgaaaggtggaagatggaagattggaatgcattttttgtatgagagacggcatagcgaactacaaatgaattcttttcatattgctgaatgtgtttcttggtcacgcagaatatggaatgaacaaattcaggtcaaaagcctgctacaaatgttccaatattgatattaagtgttccatcccttgtttttggtcagtttttgctatttattgaataataattatcctcctttctccaatatttccccaatctttgtaacatcaaaatttaaaatctgaggcaaagacatgaaaaacaaagtactgaccctggtaactatcttattaattcttccctgtacactcgcatgggccgctcagcccggggatggaaaactgaagcactttacgaagaaagacgcaacgacggcaatcgatgcttttcattctactttttataatccggagatgaaactgtatgccatttcttcggatatgaagggaagagctgccatctgggtacaggctatctattgggatatgattatgaacgcgtataaacgtacgaaggctcctgaatatcgccggttgatagaagaggtgtatcaaggcggatacgaacaatacgataaatacaattgggacaataaaatagaatggtttatttatgacgatatgatgtggtggattatttcgttggcgcgtgcttacgaaatcaccgatgatccgaaatatctggcacatgcctcttcgggattctaccatgtctggaaagagtcgtatgataaagagcggggtggcttgtggtggaatttcaagcacgatggcaagatggcttgcatcaactatccgactacggtgggtgccatgactctttataatgtaaccaaagatcccgactatctggaaaaggctaaaaacgtatatgcatggtcgagggatgttttcttcgataaagagaaaggccgtatagcagacaatatgcactatcatttccagagacagaatggtatggatattgactggaccacccaactttataatcaggctacattcatcggatcggcagtgatgctttacaaagcaaccggcgaaaagtcttacttggacgatgccattctggctgcggactatgttcgcaacgagatgtgtgattctgacggactgctgccgttcaagaacggagtggaacaaggtatttatgccgccatctttgcacagtacatcattcgcctgatagaagatggcaatcagcctcagtatatggattggttacgccacaacatagacgtggcgtggaacaaccgggatgtgaaacgcaacgtgacattcaaagatgcagccaaaccctgtccgacaggtgtgatggaaagctatgatgccagcggatgtcccgctttgatgcaagtgatttctccattcaaataacaacacaaacacgtgacaacacaaacacatgagtaagagggtattagttttgattggtttgtttttggcctgtggcggcgtctattctcaaaccgccacaggcacaaaaacgaatttccagacagcagagccgtggaaaccggaaacagatgtgcgtgccgatgccgtgatggtatacggaacgctggataagaaaggcgttacttttgagcaacgcgtacaatcgtggagagacaaaggataccgggccgagtttatgacaggggtggcctggggagattatcaggattattttcttggaaaatgggatggggtgaaagatcacctcaaagaggggcagcgtgactgcgaaggacgggaaattgcacacgggcacttgatcccctatattgtgcctactgagagtttcatccgttacatgcaggagaagcagatcaaacgggtgatcgatgcgggcattacttctatttatctggaagaaccggaattttggatgcggggcggatatagtgaagctttcaagtccgaatggcagaaatattacggatttccctggagagatcaacaggaatctcctgagaatacgtacttatcgaataaactgaaatattatctttattataacgctcttaacgagatatttacgtatgccaaagcatatggaaaatcgaaggggctggatgtgaagtgctttgtgcctacacattcactggtcaattatacgtcgtggcagatcgtaagccccgaagcgagtctggcttcgctggattgtgtagatggatatatagcgcaagtctggacaggaactgcccgcgaaccgaactattataacggagtgaagaaagagcgggtatttgagaatgcttttctcgaatatggatgtatgaaatcgatgacggctccgttgaaccgtaagatgtattttctgacggaccctattgaagatcgggcgaaggactggcttgactataagataaactatcaggctacttttgctgcccaactgatgtatccgacagtagacacgtacgaggtgatgccttggccggatcgtatttatcagggattgtatcgtgtggcggggacagaccggaaagaacgtattccgcgtgactactctacacaaatgcagattatggtaaatacgctgaacgatatacggacttcggaaacccgggtaagcggtacgcacggcatcggagtgctgatggcaaattcactgatgttccagcgctttcccgaccacgatggttatgacgatccgcaattcagcagtttctatgggcagaccttgccattacttaaaaggggaataccggtagaattggtacatatggagaatactccgtttgaggagacgtttgaagggttgaaagtgttggtcatgtcttattcgaatatgaagccgatggaaccccgttaccatgatttcctggcaacctgggtgaaaaaagggggagccttgatttattgtggtgaagatattgacccctatcagtcagtactggaatggtggaactccaatggtaaccggtataaagtcccttcggaacatttgttcgaaaagctgggactggataagtcgcctgtcaacgggacttattcttgtgggaaaggaacagtgaccgtcctgcgtgaggatccgaaacattttgtgctgaaaagtgggaatgaccaacgatattttgacacggtttcggctgcttacagaaagactgccaagaaagaaatagaactgaaaaatagtttcctgcttgaacggggaccctataccattgctgccgtattgaacgaaagcgtctctgatgctccgatggaactttcgggattatatatcgatctgtttgataaagatcttccggtgctgactcgtaaagtaattcgtcccggtgaacagggttatttatataatgtcaatcgggttccgggccggacaaaggcaaaagtcctttgcggtgcttcccggatatatgatgaaaagataggaaaacgcagttattcatttgttgcgaaaagcccgttgcatacgaccaatgtttcgagagtgcttcttccgaaacaaccgcgacgggtttgtgtgaacgggaaagaagaacttgaaccgggaaaattgtgggaagagcgttcgggtaccttactgttgaggtttgagaatgatcccgccggcgtgcaagtagatattgaatggtaaaaactataaaaaaagaatctgaagttatgaaacttaaactatcgactctgttcttaggtgcagccgccatgctgagcagttgtggtgcaccgcaggacatcaagagtgacaaaaatgagttgcgtgcgccggcttatccgttggtgacaattgacccttataccagtgcctggtcgtttacggataatctgtatgacggaccggtgaaacactggacgggtaaggatttcccgttcctgggtgttgccaaggtagacggacagatttaccgcttcatgggaacggaagaactggagctgcttccgctggtaaagacctcggaacagggcaagtggacagctaagtatacaacaacgaaaccggctgacggctggcaaaatgccgattttaatgatgctgcatggaaagaaggcgagggcgctttcggtactatggaaaatgaaagtacagccaaaacccaatggggagaagagtatatctggatacgccgtaaagcggatattaaagacaacctgcaaggtaaaaatgtatatctggaatattctcacgacgatgacgccatcatctatgtaaatggcgtgaaggtggtggataccggtaactcggctaaaaaacacatgcttgccaaactgccggaagaggctgtggccgcactgaaacagggagagaatctgattgcaatttattgtaacaaccgtgttgccaacggtctgatcgattgcggtctgttggtagagaaggacaatacacagaactttactcagacagccgtgcagaaatcagcagatgtgcaggcaatgcagaccaattacgaatttacttgtggaccggtggatctgaaacttatcttcacttcacctctctttatggacaatctcgatttgatgactcgtccggtgaactaccttacatatgaagtagcttcgaatgatggaaaaacacataacgtagaactttattttgaagccggtccgcagtgggcactcgaccagcctcatcaagaagccgtagccgaaagctttaccgaaggtgatttggtatacctcaagacaggaagccgcaatcaggaaatattgggtaaaaaaggcgatgatgtccgcattgactggggatatttctatctggctgctgacaaggaaaacagcacttgtgcaaccggagatggaaaaacactgagaaagagcttcatcgacggacaactgacttcatcgaaaaccgatggaagtgataagttggcattggttcgctcactgggtgaaacgaagaaagcagaaggacatctgctcctgggatacgatgatttatattctgttcagtattttggtgagaacctccgtccgtactggaatcgtaccggaaccgaaaccattctgtcacagtttgcaaaagccgataaagagtacgatgcattgatggataaatgtgccgcattcgatgccaatctgatgaaagaagccaccgaggccggtgggcgtaaatatgccgagctctgtgcgctggcttatcgccaggctatcgctgcccataagttggtggaagctccgaacaaggacctgttgttcctttcaaaagaaaacttcagcaatggttcaatcggtacggtagacatcacttatccttcttctcctttgttccttatgtacaatccggaattggcaaaaggtttgatgaaccacatcttctattatagcgaaagtggaaaatggaacaagccgtttgccgcacatgatgtaggtacttatccgttggctaacggtcagacatacggtggcgatatgccggtagaagaatcgggaaatatattggtactgactgctgctgtcgctgctgttgaggggaatgccgactatgctcagaaacattgggatgtactgaccacctggacggattatctggtagaatacggtctggatccggatacccagttgtgtacagacgactttgccggacactttgcacacaacgccaacctgtctatcaaagccattctgggtgtagcatcttatggctacctggctgataagttgggcaagaaagaagtggctgagaaatatacacagaaagccaaagaaatggctgccgaatgggtgaagatggcagatgacggtgatcactaccgcctaacctttgacaagcccggaacttggagccagaagtacaatctggtatgggataaactgatgaatctgcagatattccctgaaacagttgcgcagaaagagatagcttactatcttggcaagcagaacagatatggattgccgctggataaccgtgaaacttataccaagaccgactggattatgtggactgctacactggcaccggataaagccacattcgagaagtttatcgacccggtttacctgttcatgaacgagactaccgaccgtgtaccgatgtctgactgggtatttaccgatcgtcccaaccagagaggtttccaggctcgttcggtagtaggcggatactatatcaagatgcttgagaagaagttgaaaaaataagattctgtcacaggttacacggattttcacaggttaatcatttttcccattgatattgaagattaaaaaatctgtgttaatccgcgtaatctgtggtgaatttaaaaccattattatcatgaagaaattagcgctattacttgttggcgtactgggtactgctctttgtacttttgcaaagaacacaacagagccggtggactatgtgagtccgttggttggtacccagtcaaaacatgctttgtctaccggaaatacatatccggctattgccatgccttgggggatgaacttctgggtggcacaaaccgggaaaatgggtgacggatgggcttatacgtatgatgctgataaaatcagagggtttaaacaaactcaccagcccagcccgtggattaatgactacgggcagtttgccattatgcctgttacgggaaaggtggtattcgatcaggatcagcgcgcaagctggttctcgcataaagctgaggttgccaaaccgtattattataaagtatatctggccgatcatgatgtaactaccgagattgctccgaccagccgtgcggctatgttccgtttcacttttcctgaaagcaatgactcttatgtggtggtagatgctttcgacaacggttcgtatgtgaaggtgattccggaagagaacaaaatcatcggatacacgaccaagaacagtggaggtgtacccaagaactttaaaaattactttgtactggttttcgataaaccgttcactttcactgcggcagtaaccaacggtaatatctgtccgggtgaattggaatcgaaagataaacatgccggtggtattatcggtttctccacccgtcgtggagaaacggtaaacgtgcgtgtcgcttcctccttcatcagtcccgaacaggctgaacagaacctgaaagaactgggcaaagacaatctggaagctgttgctgccaaagggcgccaggagtggaacaaggtgctgggacgcattgaggtggaagacgataatatggatcatctccgcacgttctattcttgtctgtatcgttcggtactcttcccgagaagtttttatgaactggatgccaaaggaagcccggtacattacagcccctacaatgggaaagtcttgccgggttatatgtttaccgataccggtttctgggatactttccgttgcctgttcccgttcctcaacctgatgtatccttcgatgaacgaaaagatgcaagaaggattggtgaatacttataaagagagtggatttcttcccgaatgggcaagcccgggtcacagaggctgtatggtaggaaacaattccgcttcggtagtcgccgatgcctatctgaaaggtctgaaaggatacgagatagaaaccctctgggaggcagtgaagcatggtgcgaatgcagttcatccgcaggtttcctctaccggacgtctcggttacgagtattacaataaactgggttacgtaccttacaatgtaggtattaacgagaatgccgcccgtacgctggaatacgcttatgatgactggtgtatctatcaactgggccgggcgctgaataagcccgaagaagagatagctgtctatgcacagcgtgccatgaactataagaacctgtacgataaagaacataagctgatgcgtggcaagaataaggacggacaattccagtcaccattcaatccgctgaagtggggtgacgctttcaccgaaggaaacagctggcattatacctggtccgtattccatgatcctcagggactgatcgatctgatgggcggacagcaaggattcaaccaaatgatggactcggtgtttatcctgcctcctgtatttgatgacagctattacggtggtgtgattcatgagatccgtgaaatgcagatcatgaatatgggacagtatgcccacggtaaccagcctatccagcatatgctttatctgtacaattactcgggacaaccgtggaaagcgcagcattggattcgtgaggtgatggataaactttatacacccaatcctgacggttattgcggcgacgaagacaacgggcagacatcggcctggtatgtgttctctgcaatgggattctatcccgtatgtccgggaacggatcagtacgtgatgggtacaccgtacttcaagcagatgaaactgcatctcgaaaatggcaagacggtggtaatcagtgcaccgggtaatagtgatgaaaaccgttacatcgcgtcgatgactgtaaatggtaagtcgttaacccgcaattacctgacacataaagaactgatgaacggtgcgaagatcacgatgaaaatgtcgtctactcccaacaaacagcgcggagtgcgtgaatcggattttccatattcgttttctaaagaagttcgttgaggctgcaaaaaagataacttatataaaccaatcaagattatgccaggaaaaaactcaaagaaaatgatcggggcatgtgtcgtaactgcggcattgctctgtgtaccttcggttctgaaggcagaaggtatgttgtcacattatacttgtgtggcagatgctattcagaaagacaaccgtccggaaccggctaaacgtctgttccgttcacaggcagtagaaaatgaaattatccgcgtacagaagctgttgcgtaattcgaagttggcctggatgtttaccaactgttttccgaatacgctggataccaccgtacactttcgtatgggcaaggacggcaaacccgatacttttgtttataccggagatattcatgccatgtggcttcgcgactcgggcgcccaggtatggccttatgtacagctcgccaactccgatccggagttgaaaaaaatgcttgccggagtgatcaaccgccaattcaagtgtatcaatatcgatccgtatgccaatgcgttcaatgacggtcctaaaggcggcgaatggatgagtgacctgacggacatgaagcctgaactgcatgaacgtaaatgggaaatcgactcactctgctatcccttgcgtctggcttatcagtactggaagacaacaggtgatgccagtatcttcgatgaagaatggatacaggcgattaccaatgtattgcgtacttttaaagaacaacagcgtaaagacggtgtaggcccgtataagttccagcgtaagacagagcgtgcactcgacacggtgactaacgacggactgggtaatccggtgaaaccagtcggactgattgtttctactttccgtccttcggatgatgctaccacactgcaatatctggttccttcgaatttctttgccgtgtcttcgcttcgtaaggcagccgagattctgacaacggtaaataaaaagaccgctttggccaacgaatgtaaggctttggcagatgaagtggagacagccttgaaaaaatatgctgtttacgatcatcccaaatacggaaagatctatgctttcgaggtagacggttttggcaaccatatgctgatggacgatgcaaacgttccgagtttgctggctatgccttatctgggcgatgtttcactggacgatccgatttatcagaatacccgtcgctttgtgtggagcctcgacaatccttacttctttacaggtaaggcaggcgaaggcattggcggaccgcatatcggttacgatatggtatggcctatgagtatcatgatgaaggctttcaccagcaaagacgatgcagaaatcaagtcgtgtattaaaatgctgatgaatacggatgcgggtacaggctttatgcacgaatcgttccacaaagacaatccggagaaatttacccgtgcctggtttgcgtggcagaacactttgttcggcgaattgatcctgaaactggtgaacgaaggtaaagtggatatgctgaatagtatacaataagaatataacgaaacagaaaagaatacgattcaccacagattacgcggattaccacagaatttttgatataaagtctcaataggacaatttattaatctgtggaaatctgtgtaatctgtggtggactcaaaacagtttaatcatgaagaaattagctgtatgggcacttggtgccctctttgtagccggttgtgcaaagacagaacagactactacggattccggtttggtgaagagtaacttccggactgaagtgaacggaaagaaaaccgatttatacgtactccggaatcagaacaacatggaggtttgcgtcactaactttggcggacgcatcgtttcggtgatggttcccggtaaagacggggtgatgcgtgatgtggtacttggcttcgattccattcaggattatatcagcaaaccttcggattttggtgcgagcataggccgttatgccaatcgcatcaatcagggaaagtttacgctggatggtgttgaataccagttgccgcgcaataactacggacattgcctgcatggtggtccgaagggataccagtatcaggtatatgatgctcttcagaccggtcctcaggaacttgaactgacctatcgctcaaaagacggtgaggaaggtttccccggtaacattacttgcaaagtaatcatgaaactgacagacgataatgcgattgatattcagtatgaagccgaaactgacaaaccgactatcgtcaacatgaccaaccactcttatttcaatctggatggtgatgccggcagcaacgcagatcatctgctgactatcgacgccgattcttacactccggtggacagcacctttatgactacaggtgagattgtgacagtggaaggtactccgatggacttccgcacaccgactccggttggtgcacgtatcaacgattttgattttgttcagttgaagaatggcaatggctacgatcataactgggtgctgaatgccaagggagatattacccggaaagccgcaactctcgaatcgcccaagacaggtatcgtacttgatgtatataccaacgaaccgggtattcaggtgtatgccggcaacttcctcgatggttcgctgaccggaaagaaaggcattacttacaatcaacgtgcttctgtctgtctggagactcagaaatatcccgatacaccgaacaagcccgaatggccttcggctgtgttgcgcccgggtgagaaatataacagtcattgtatattcaagttctcggttgacaacggcaaataatcacaagcgtttttagttgtattggcataaggaacataggatccgacgggtctgattctatatccttatgccttttttaattccttatgttcataccataacacatacacaaactaaaggtaagattgataccgataacctgttgaagttagactggtttcagtttaataagcgccgaagaaaatagtcggttggcttaatactgatcagaaacgaatacgattcaccacagaggacacagagaacacagaggacacagagttttaatctcttgtttattaagatgtttaagagaaagatattctctgtgtcctctgtgtcctctgtgtcctccgtggtgaattaaactcaaaacccttacagttatgaaaaagaaaatgattattggcgggacaatgttgctgggattactgattacgttttgttcgtatacaggagttactgaaaagccggacatccccgaagtgaaagctatgggagagtcggttccattgggtgatccattcattctgttgcacgacggcgtttattatgcctatggaacgcatgcggcagatggcattgaagtctatacttcaaaggacttgaagaggtggaaactgcatgggctggcactgaataaagaagatgtgtgggcggatagccgcttctgggcacctgagatttatgagatccatggtaagttttatatgtattatacggcggacgaacacatctgcgtagcgatttccgattcacccgtaggaccgttcaggcagaaggaaaagaaaccaatgatagctgacgagaaaatgatcgacagttcgttgtttattgatgatgacgggaagccgtatcttttctttgtccggttcaacgacggtaacaacgtgtgggtagccgaactggaaaatgattatatgacgatcaaagcagaaaccatgcgtccttgcattcatgtgtcccaagcatgggaagaagtctggccccgggtcaacgagggttcttatgtgcttaaacacaaggggctgtattatatgacctattccggtaatagctttgaaagtccgttctatggggtaggctgtgctacggcaaccgatataatgggcgaatggaccaaatatgatgaaaaccctattttgcagaaccccgatactttgcagggtgtagggcatagcgctatgttcaaagataaagagggtaaacttcgtatcgtttatcatgcacataaggataaagagcatattcatccgcgtggaatgtatattggttctgtcagctttcaaaaggtgaatggtgtggaccgtatgcgcattagcaaagattatattactgcagagctggtaaagtaaagcagagagagtgatttgataatatgatcctgttttcctgtatcagctttcaaaaagtaactgaaatgctttttctgataactacctcttcttttctttctgttcaaccggaaggataggagggcgataaccggggtaaatgcaatgaaaagccgggctttttggactctgaagccggcatttcccggaaaagaagtaagcatccggcacaaaagaagtaagcaatttccgaaaatgcttacttcttttttgaaaatctcctaatgttttgcccgattacatatattgttccggaatagagagattattttcctcctttcttttctggttgacaagtacaggagatccctctctgactttctaaaagcactttctttttacgaaaaacaaacatgagtgctcttggttccccctttggacattcattgtgttgtgaaaacgtccggattcctgcaatatgataaacagaaaaatgaaatggagacgatttttagtacgaacctggctaatgtactgaaataatcgaaccagagaagggctgtttagcaaactgtcaaaaagctatatggcatgtttcttttgatgccgaactaatttataaaggagcagatttcatttgtttctttcgtaattctgatttgaggttgttatctttgttgcgataactttaaagggcagtattaagaaaacacacattcttcattttagacgcgattatggttaaactcttattgatatgtctggcagcgatagtgatgatctcttgcggatcggagcaagaaaagttaactgtgtatatttccgatacgtgtacggatactcttcaacacgaaatcttcttgtcggaagaagaaggactgaatattttctatgatttgtgtgtaactgattctttttgtgcttttttggacgcacgtaatgatacattattaaagattttcacagttacagttcctcctgcttttgtcggattggggatgaaaggagaggggccggatgattttctttttcctttttttgagaagtcgataggcaggggaggcaagggaaaactatcgttcattgaattgaatagttggaataaaaagactgttgcgattcattcggcagcatctcccggtcctgtcgctgtttctgttgttgaggcacaacaattgccggagatgcctgtagtcagggattataatgaaacagactcttgtgtatatggcattgatgtagatatgcagcatggtttgtttttcatttatgataagcatactgcccgggttaagacagtggattatcatcgtgatattaagtctggatatccggaaggacatttatcttatctatacgagagctgtttaatggtaaatcaagatgcaaaggcagcttgtacgggattgctgaacctgaactctctctgtttttatgatttaaaaggaaatctgatgaaagaaatggtgatagggaaagagctgaaatacccggactatgatcctgattttcttgattttccgaatgcacctaaatatttcatttctctttgtggcacccccaattatctttatgccctttataacggtttcccgggtacttcgggtaaatcaaagattatggtctttacctggcaaggtgcttcggttgccatttatcacacagatgtaaaattggagagaattgccgttgatccatccggcagatatgtattgggactgaatataacggaagagggagggagtgatgtgttgaagtttgactttcctcttaatgaagtttaactctgttaggtgcttatattcagcactatcctttaactttgcctgaaacataaaaccacatgactatgaagactttttattccgtcttttatttatgcttcttgctctgcctgcttttttccgtggtgggatgttcggaagataatgaactatccggggagattgaaataaaccagctgccaggtactgcgcagttctttttatctaattattttccgggacaatctccggagaagatagaaagaacgatgaccgggcaggagaatgatcagttgctctaccgggttgcttttcccgatgaggtgaaagtggaatttaatgaaaatggaggatggaagagtctgatggttccaaatcaaaacttgcccgaatcacttcaatccctttttggagaagtcatcgcatatgtaaaacaacacttctctaatgatccgtttgtcggtgtgaagaacacctgttacggagaatgtgtgttattgaacagtggcaagaaagtagcattctactacgaccaaacctgtgtcggatatgaaatggatataaaaggtgaatcttcattgccgcaaccggtgcgggagtttactgaaaaatactttccggatggaacctttgaggctgtgattgaacatatacctgacggggagtttcctgccggttatactttctggttggagaacggatttaaatgcgtgcttgatgataggggagagtggacggaagtgaatggaggaaccgaactgttgccgacttcgattctggaaacattacctgcgaaagtgacggaagatttgcaccggaactatccgaatgcacaagtcaccttcattcgtctggagggtacccgttatacaattcaggtcagcaagactgtgtatgtgactatcgatcccgagagtaaaccgatagaggtacctctgatgcaggcacaggcacttgcagaagagtatttcggtaagcagagttccatctctatcagtcatccgctgcattcggatgtgctcaactttaccgtccgcctgccgaacggctttaatatgcttgttaacgaagatgccagtgcatggattaatatagacggaaacggatttgcgtttccggagaagctcgtggcatcgttgccggaaaagattaccgattatgtttcgggatattcgaactctgaaatcacacgggtagaccgttcggtggcagcttcctatttggtggaactaaccaacggagacggattgatgttcgactcacagggagattttcttgggaaagaaaagatagagttgagcgcctcagagaaggtgtacaggtatatgcgttatcattatcccaatgacctggatatgtatctcggctcttacagcatagagggttgggtatacaaactgagtgacggttcgcaagtcagattcgaccggaacggtaattttgtggagatcatctcattaaagtgagtgccggatattcagttcccaggggttctctatggtttttatctctttctgcgtaagaagtgaagccatggtttgccccatttgcttgaagtcggtggataaagtagtgatacctccggccagtatctctttcagcggagtatcgttgtaagagatgataccgaagtctttaccgggaacaaactgctgtagttgcgcctgtttaagcagatctaccaaatcccggtcgttgacagtcataaatatttctcctttcttgatcatccggtcctttacggagtcggtatattcgtgtgtaaactgatgttcctcacagaaagtacagaggccgttgtatcgttcgataggctctttctcttccttctggaccatgatgatgtggtcgtattttttcaggtgcgggagtccgtgtaccaaagcttcgtaagtgtctttctcgaaattctgtgcaacggaggagtatttgcctgccagttccgggtgaaagtggtcgagtaggaagacccgtccggataggctctccaatagtggggctatgttggtgaacttgcccggcatcaggatatatgtggtgtacttatagttggcttcattgatgagcgtctcgaagactttgcggttatagttgtgaaaatagagatctacgtttgcggtctttttgatggaagacatgaatgaattgtaaagatcttccttgaactcgttgaattcgttgaaaaggaggaatacatttagcttttgcgcaattcgggttgttgctatgtaataacctacacccggggtggaatcgataattccttttgatttaagctcgctcaaacctgcgaataccgtatctctggatagattatagttctttctgaattcattgatagagagaatccagtctccttttttataactaccattgttgatgccgtctataacgtgatttactacttgtttgtattttgattcattccttttcatattcttgtttttggtgctgcaaagataggataaaaaacgtaaaaggctatggatattctccggatatagtatatgttttgtaacataataaaaatacagaccagttcgtatcagttttgatggctttcattatctttgcactgttgcttggatcataagaatcataagcaagaaagaaagacgggaaaacaacaaactataaataaaacaatgagaacgtacagatttatgtttccggtgttgcttgcaatgactgcgaccggaagtttgacggcaaagtcgtctgataaaggaggttccggcattcagtttccggaagtaagccaggtgaaaatagaagatgcattttggaaacccaaattggatctttggcagaaggtgacggtgaatgatgtctttgacaagtttgaagggaagcatctggaacatccgggaaaattctgtaatacgtttgagaactttgaccgtgtagcaaagggcgagcgaaatatcggtcagcatgcaggtgctccctggtttgacggacttgtttacgaaacaatccgtggggtggcagacttgatggcaagacagtcggatgttgctttggagaaacgtgtcgacggatatatcgaccgaatagctaaggcacaggcatcggagcccaatggttatatcgatacttatactcaactgatggaagctgaccatcagtggggagaacggggaggaatgcttcgttggcaacacgatgtgtacaatgccggtatgctggtggaagcagggatacattattataatgcaaccggaaaaacgaagttgctggaagtggcaacccgctgtgccaatctgatggctggatacatgggggctttccctaaaaagaatgtggttccggcccattccggtccggaagaggctttggtgaaactttatatcatttataaaaacaatccggaactgaaaaagcaaatcaatgtcccggttgctgagcaggactatctcaaattggccgaattctggatcgaaggcagaggacatcactgtggattccctttgtggggtacatggggtaatccgtctgccgaacaatggatacgtgaccggaaatatgaagctcccgaattcgggaatcatacccgtccgtcatggggggactatgcacaagattccattccgcttttcgaacagaagactattgaaggacatgccgttcgtgctactttgtttgctaccggagcaacggctgccgcacttgagaatcattcaccggaatatatcgctgccgttagtcgtttatgggataatatgattggaaagcgtatgttcatcaccggcggagtaggtgctgttcactttgacgagaagttcggacccgattactttctgcctacagatgcttatctggaaacttgtgctgctgtcggtgccggtttcttcagtcaaagaatgaacgagctgacaggtgatgccaagtatatggacgaattggaacgcaccttatataataacgtcctgacaggtatttctctttccggcacacaatacacttaccagaatccgctgaactctgctaaacatgcccgttggagctggcacgattgtccttgttgtccgccaatgttccttaagatgatgtctgcaatgcccggatttatctactcgcagaagggaagtgacgtttatgtgaacctttttgttggtagcgaaacggaaatgactctggcggatcggaaccgggtacgtttgacgcaaaagaccggttatccgtgggagggtgttgtcaccatgaccgttgaacccgaaaaagagaagacttttatattgaaagtgcgtatcccgggatgggcgcaaggtgtggagaatccttatggcctgtatcgttcggaggtacggtctgccgtaagcctgaaggtaaacggtaagtcggttccactaaaaatattcaaaggatatgccgaaattcaacggaaatggaaaaagggggatcaagttgagctgatactacccgttcagccgcgtttggtgacagccaatgaagcagtggcggatttacaggacaaagtagccattgccgccggtccctttgtatattgtctggaaggatgtgataatgaaggtttggctgatttgaaggttgatatgcgttctcccctgtcgatcacttttgaaaagggattattgaatggaatcaatgtaattaaaggtcaggcactggataagacaggaaagaaagtaccggttacggctattccttattatgctttgggcaatcgccaggataagggttatgcggtttggattccggcaagtaaataatgcgaacgaacataaacacaattgtaaaatgagggtaaactgtttgttagctctgatattgtctgcttcggtagtagcggcacaggacgctgtgatccgggtggatgcgggtaaggtcgagaataaaataactccttatttatatggagcttgcatggaagatgtaaatcatgagatttatgggggaatttatgatcagcagatttttggcgagagctttgaagaacctgcctccatggataactttattgggtttacccggtgcgaaggggtatggaagatgcaagatgatcaactttccgtatcgtcgcatccgggggcgaaattggtttatgatgatgcggagttctctgacggtagggccggagtcgatataaaatttaccgatgacatttcgtctgccaataatgcgggacttttgttgcgcgtcggtgaatacggaggtggagcggataattttgatggatacgaagtcagcctgtttgccgatggcaaacgcgtgctgttaggtaagcatctgcacaactggcaggaactgaaaacagttccggtagatgtagatccgtcgcaatggaatcgtatggaagtgaagatggagggtgatgaactggtgattctgctgaacagtcgtgaagtattgcgtttcgaagatcatcttaccactttacgtaatggaaaggtcgctttccgcaattggggtgccggtgcatctttccgtaacctgaccatcggagatggtactcctgtcaggctgttaacccgatcggcaccacaggtcagtggcatgtgggatgcttttgcagatctgaatgcggccgcttcatataaacaggtttcggacagaccttttcatggacactatgctcagcaagtagagtgtctggcaggtatcggtaaagtgggcattgccaaccggagcttgaatcgctgggggatctccgtacgtcagggtgagaagaaaaccggtagcctttatttgaaagggaaggcagaagtatgggtagcccttcaaagcgtggatggtgaaaaagaatatgctgtacagtgtatccgtaccgagtccggtgactggaaaaagtatacatttgagttgattccggacaagaccgatgaaaacgcacgctttgccatttatttgaaagggaaagggcgttttctggtagatatggtcactttgatgaacggtgccgaccgacagtttcgtgggttgccgttgcgtaatgatatcgggcaggcaatggtggatcaggggttgcgtttcctgcgctatggaggtacgatggttaatgctcccgaataccgttttaagaacatgattggtgatcgtgcactgcgtccgccttataaaggtcactggtatacttattcgactaacggtttcggtatcgaggatttcctccggttctgcgagaaggcagggtttgtgcctgcttatgcagtgaatgtagaagagtcggcgcaggatatggcggacatgattgaatacttgaacgggccggtagatacggaatgggggaagaagcgtgccgcgaacgggcatcccgaaccttacggattgaagtatctggagattggaaacgaagaggtcatctggggggatatcgaggcagagtatcagcattacattgatcgttttaatgatatctatgaagcggttcatgccaaagatccggaggtgcaatttattcattctgcctggtggcgtcccgaatcgcctaacatggaaaaagtatttaaagcccttgacggaaaagctgcttattgggattatcacccttggacggatgatctcggtagccgtgagaatatagacagggagttgacggatatgaaggccaagttcttgaaatggaatccgaatacaatgatgcgttgtgccatttttgaagaaaatggaaacctgcataacattcagcgtgccattgtacatgctaccgttcagaatgtagttcgtcgccatggtgacttcatcctgactacctgtgcggccaatgcccttcaaccttatctgcaaaatgacaatggttgggatcaggggcaggtatttttcacaccgggacaggtttggggaatgccgactttctatgcacagcagatgtctgctgcccatcaccatccgttacgtttgtggagtgaagtgaaaggagaactggatgtgacagccacaacgaatgaagcacgtgatgaagtggttctgcatgttgtgaacacttcacctgaggtacggcgaagccagataaacttgtccggtttcattccggagggaaatatggaaatatatactttgagtggagaactgaatgacgaaaatcttcccgatacgccgacccggattcttccgaaagctatctggatgcaggctgccggatctgattttacttattcgtttcctgcttactcgtatacgattgtcgtgcttgggaagtaagttatcgttatgggaattaacattgttaatgccgcttcggaaagttttgctgacagattgtaaacaacaaatcttttgcatgtaaaagatttgttgtttacaatcaaaacacttgttttaacagatcgttaaaacaagtgttccttcaatgtgatataaacacttataaccttctatttatcagccggaacctaatcaaaggacctttgtttcctaaagcctctgcctgcatggcttcaagtgatctacttgtcagaatgacaagtagaatataattgatgagaagttatagaaccttttatggtctgaaaatagctgatacattgcacgaatttgttccaccggccgacagcactacagacggaagggtcagatttccaagccgtccagtatcttcagatataactccaatgcttcttcgatttctttaatcatgatatattcatcggctgtatgtgaacgcgaagaacggccgggacccatttttaccgaagggaaagacattaacgcctgatcagaaagggtaggggaaccgaaaggtatacgtcccagtttttttgctttttgtacaaacggatgactctcttcgatacgtgaagagttaaggcggaatgagcgggcttcggctttgcaggaaatatgtttttgtatttcggcaaacagttcttcattggagtaaagttcgttgcttcgtacgtccactacgaaactgcaacggtcggggatgacattgtgctgtgtaccggcattgatcaccgtgacactcattttgacagggcccagcagagacgattctttggcaaaacggtaatcgcggaaccaggcaatgtcgtccaataccttatatatagcattatcaccttcattacgggctgcgtgtcctgcttttccgatggcagtgacatcaagtaccattaaccctttttcggcaatggcaggttgcatttcggtaggttctcccactacggcaaaactgataggaggaagtccgggcaatacactttcgatacccccttttcccgatacttcttcttcgcaggatgccagataaatgaggttataactttgttgcctgcggcatagttgcagaaacacctgtaagagtgtcactacgcttgcaccggcatcgttgctgcccaatccgtaaagtttcccattctcttcgcggggagtgaacggatcttttcgccaaccgttgaccggttttacggtatcgatatgggaattgagcaggattgtcggtttcttcaggtcgaacatgggactcagacaccagatgttgtttcctttacggcctgtggtcataccttcggcctcgatatagttttgcaggtaatcggctgctttttcttcttcgcggctgagcgaagggatgctgatcagagatttcagcaagccgacagcttcggatgtaatggattcgtctatcatttctttttttgctttgaacggatgcaaatgtacaaataatacttgaatctttcagtttgtcagacaactatttatcaggtactatatggctaagtgcctgactctgttaagcaaaataattcagtgttcacacctgataattccaaattaaacgatacctttgcagacgaataactaacaacaaaggatatgacttatcatcatttatctgtcttggttcatcgtcaggctgaaaagtatggcgacaagacagctctgaaataccgtgactatgagaaggcacagtggatccctatctcttggaatgaattctcgcaaactgtaaggcaggccgccaatgccatggtggaactgggggtacaggaagaagaaaacatcggtattttctctcaaaataagccggaatgtctgtttacggattttgccgcttttgctaatcgtgcggtgacgattccactctatgcaaccagctctccggcacaggcacaatacattatcaatgatgcacagatacgtttcttatttgtaggagagcagttccaatacgatgctgctttcagtgtatttggcttttgcccttcacttacccagttaattattttcgatccggcagtagtaagagacccgcgtgatatgagttccatctactttgacgagtttctggctaaaggaaaagatttgccgcacaacgaagtggtggaagaacgtacggcacgtgccggtgctgatgatttggcaaatatattgtatacgtccggtactaccggtgagcccaaaggagtgatgttgcatcattcttgctatctggaagcattccgcattcacgatattcgtttggtggatatgaccgacaaggacgtttcgatgaacttcctgcctctgacccatgtgtttgagaaggcgtggacttatctctgtgtgcataaaggagtacaggtatgtatcaatctccgtccggctgacatccagacgacgattaaagaaattcgtccgacgttgatgtgcagtgtaccccgtttttgggaaaaagtatatgcaggtgtccaggagaaaattgccgagactaccggtatcaagaaaatgttgatgctggatgccatcaaggtagggcgtatccacaatcttgagtatctgcgggtaggtaagacgcctcccaaaatgattcagctgaaatataaattctacgaaaagactatttatgccttattgaaaaagactatcggtatagagaatggtaacttcttcccgacggccggtgccgctgttcctgatgaaatctgtgaatttgtgcattccgtaggtatcgatatgttggtgggatatggtttgacggaatctactgcgactgtttcgtgtacttcgaagaccggttatgacatcggttcggtaggacaagtgatgccggaggtagaggtaaagatcggggaagacaatgaaattctgcttcggggaaaaacgatcacgaagggatattataagaaagcggaagctacggcagctgctattgatgaagagggatggttccataccggagatgccggctatttcaaaaatggtcagttgtatctgacggaacgtatcaaggatctgttcaaaacatcgaatggaaaatacattgctccccaggcattggaaaccaaattggttattgaccgttatatcgaccagatagctattattgccgaccagcgtaaatttgtatctgcgctgattgtacccgtatacggctttgtgaaacagtatgccaaagagaaaggtatcgaatacaaggacatgaccgaactgttggagcatcctaagattattgctttgttccgtgcacgtattgacacgctgcagcaacaatttgcccactacgaacagattaaacgtttcacattgcttcctgaaccgttcagtatggaaaagggagaactgactaacactctgaaactgaaacgcccggtagtggcacgcaattataaagaggtaattgataaaatgtatgaggagtaagaacacgaaattttgtatatctttgctccccattattaacgaaaaccataaataagaagtatgattactattgaacaacttaaagacgtgaaagagcgcactgatgcgctgaggaggtatctttgacatcgacgggaagaaaattcaggtcgaagaagaacaattgagaacacaggctccgggattctgggatgaccagaagaaggccgaagcacaaatgaaactggtgaaaggattacagaagtggattgacggttacaacgaagtcaaaacactggcagacgaactggagctggctttcgatttttataaagacgaactggtcaccgagcaggaggtggacgaggcgtatgcaaaggctctggaacatgtggaaaacctggagttgcagaatatgcttcgtgatgaagccgaccagatgagttgcgtgctgaagattaactccggtgccggtggcacagagagtcaggactgggcatcgatgctgatgcgtatgtatcttcgttatgccgagaccaatggttataaagcaaccatggccaacttgcaggaaggtgatgaagcgggtattaaaacctgtaccatccagatcgaaggcgactatgcttatggatatctgaaaggtgaaaacggtgtacaccgtttggttcgtgtttccccttacaatgcgcagggtaagcgcatgacttcttttgcttccgtgtttgtcactccgttggtggacgatagcattgaagtgaatattttgccggcctgtatctcttgggatactttccgttcgggaggtgccggtggacagaacgtaaataaagtggaatccggcgttcgtttgcgttatcagtacaaggacccttataccggagaggaagaggaaatcctgattgaaaataccgaaacccgtgaccagcctaagaaccgggagaatgcgatgcgtcagttgcgctctattctttacgataaagaattgcagcaccgcatggccgaacaggccaaagtggaagccggtaagaaaaaaatcgaatgggggtcgcagatacgaagctatgtatttgatgaccgtcgtgtaaaagaccatcgtaccaacttccagacctctgatgtaaacggagtgatggatggtaaaatagaaggctttatcaaggcttatctgatggaattttcgtccgaagaggcttaaacataacagaattgtaacatcctccggggttttctgccccggaggatgttttttttatttcctttctttgttcatcattttattctccatatttttggctggttaaaagatttgttcttactttgttagcgttgaactttaaagctaacgattatgagtaagaataagaaaaaagtaacacacagcaagaaagaagaagaacaagccaaaaaggtcgttaaggtagtttttgtctcgctggtcattctggcattggctatgattatcggtttttctcttttgggctaagagtgagtgattagtgactgacaattagtgattagtaccgtatagatgaattgtactaatcaccggttattagctgctaatcactgccaattaatcgctaatcactaaaaagacggatgaacaagcaactgattactattttttctatcttctcaattacttgtctggggatggtttctgcccaggagtctaaatcttttcttcctgaggtgaagaaagaatcattaaccttcagttcggaggacaataagtttaaactgactttcaatggccgtatccaggcagatggagcggtgttttttggagaggattaccagcccataggcaatggtgtcggatttaggcgtgtacgtttaggtgccactgctgcatttggtaaaagattatccggtaaaatagagatggatctgaccgatggcggattttcgttaaaagactgtttcattaaatatgcttttcccaacgggctctactttagggcaggtaattttaaagagagttttgggatggctgcaatgacttcttcgggcgatttatggtttatggagaaagcgaatgtggtatcggcatttgctcctgaatatcatattggcgtacagggaacttgggaacatgaccagttcctgggggtagcaggtgtacatttcaagcgaattgaaggtaataaagaaaaagattattctgaaagtaacaacaaagccggagaagatgaaggaatatcggtgactgcccgtgcggtttggcaacctgtttcggcagataaagtgaaaggctttcatctgggaattgctgcatcttatcgcactccgaagactacggttggttcactgatgccaaatacggtgagatacagtacaaggtcgctgtcttatatcaataaaatcaagtttctggatacgtcgcctattgcctcggtcagtcacgactggctggcgggtgccgagttggccggattctacagagggtttcgttttcagggagaatacattatgaacaacacagtgcgtatggaaggattagcgacggagaagttcaatggtttctatgtacaggctgcttatctgctgtttggcggacagcagcggtatagtaaatcacgtggcgctttttcgcagccgtcgtttgggcgtagttggggcgacatagaactggcagcccgttttgaccgtatcgacctgaacggaacagaggtgatgggcggatcggccaacggatggacgtttggggtgaattattatgctacccggaatcttaaattccagattaactattcgtatgtagataatgataaatatgccaatgccttcggacaggcagcggtggggtataaatcgaacggagagattgcttacaaacccgaggaagtagacgaatcgttggggaagggggggaatgcatatggcattctgggactccgtatacaattgaatttttaaatatgccacaagagatagaacgtaagtttctcgttaaaggagactataaatcacaggcttttgcgcagagtcgcattgttcagggctatatcagcagtgcccgtggaagaacggtccgggtacgtatccgcgatggaaaaggttacctgactattaaaggagcctccgatgcttcggggttgagccgctatgagtgggagaaagaactgccgcttattgaggcagaggaactgatgaaactttgtgaaccgggagtgatcgataaaacccgatacctggttcgttgcgggaaacacgtattcgaaatagatgaattctacggtgagaatgaaggacttgtagtagctgaggttgaattgggggcagaggatgaaatgtttgtaaaacctgactttatcggggaagaggtaactggggatgttcgctactataattcccagttaatgaaaaaaccgtatactacctggccgtagctaacaaataatccgtatatttgtttctttagttacgggctcaagaataaagatatatggaacaactgtacaactacttgccggaaaagctggtgacctttattctggtcaccttgttttcacttttaataggactctcgcaacgcaagatcagtctgaagcgtgaaggagaaaccactcttttcggtacggaccgcacctttacgtttattggaatgttagggtaccttttgtatatcctcgatccggaagagatgcggctctttatgggaggcgggttgatactcggtatgcttctgggattgaactattacgtaaaacaagcccagtttcacgtattcggggtgacgaccatcatcattgcgctgatcacttattgcattgctcctattgtttctacacagccctcctggttttatgtcatggtgattgtaaccgttttattgttcactgaattgaagcatacctttacggagattgcacagcgaatgaaaaacgatgaaatgatcacacttgccaaatttttggctatcagtggaattattctccccatgctgcccaatgagaatatcattccggatatcaatctgaccccctataccatttggctggctacagtagttgtctcgggcatttcttacctttcttatttgttgaagcgatatgtctttcgtgaatcgggagtattggtttccggtatcatcggtggattgtatagcagtacggccactatttcagtattggcgcgtaaaagcaggaatatccactcgcaggaagcacccgaatacgttgctgccatgctgttggctgtgagtatgatgtttctgcgttttatgattttaattcttattttcagttccaccatctttgcctctatctatccttatcttttgattatggctgctgttgcagccggcgttgcctggtttatccactgccggcggaaacggacgcctggtgctgatcttgtggaagaagaggatgacagcagtaaccctttggagttcaaagtagcactgatttttgccggactattcgttatctttactgtgttgacacattacacattgatttatgccggtaccggaggattgaacttattatcgtttgtgtccggattcagtgatatcactcctttcatcctgaacttattgcagggaaccgggagtgtggcggccactgttgtgatggcttgtaccatgcaggccattatcagcaatattgtggtgaatatgtgttatgcacttttcttttcgggtaaacagagtaagttgcgctcatggatattaggcggtttcggctgtgtgattgcggcaaatgttgtcgtactttttttcttttatctgatttaatgtgcgttatcgaacaacttctgataaaaaagaataaaaattgccctatttcacctttcttaactccgagggtttcgtaaacgaatataaagtcgatattttcgttgccaatctgtaacaaatactatgattttgcgtctgatagactataaactaaaacataacttcacatgagaaacaaactactactattattgctgttgatgtttataacatccggcatgatgtatgctcaacagcagaaacctcagcaaacccagcaacgtacagcagctccatcttatacattgaaaggcgtgcttcttgactcgctgacgcaagagggagaaccttatgctacgatcaaaattgtgaaaaagagtgctccccaaaaagctttgaaaatggccgtaactgacttgaatggtaaattccaggaaaaattgactgtcgctcccggaaactatgtcgctactttttcatctgtaggtaaagtgacattggtgaaagacttcaccgtaaaggcaggagataaagtaattgacctcggacaattgaatatggccgaggctactaacgaactgaagggcatagagatcgttgcccagaaaccattggtaaaggtggatgtggacaagattgaatataacattgaggacgacccggactcaaagaccaacacagtgatggaaatgcttcgtaaagtcccgttggttacagtggacggtgaagacaacattaaggtgaatggcagcagcagttttaaaatccatgtaaacggtaagccgaataacatgatgagcaataatccgaaagatgtgctcaaaagtatgcctgctaatacaattaagcatatcgaggtaatcacttctccgggagctaaatatgatgcagaaggtgtaggcggtatcctgaatatcgttactgtaggcggtggctttgaagggtataccgctactttccgtgccagtggcagtaaccgtggtgccggtgcgggcggatatgccactattaagtcgggtaaactgactctgaccggtaactataactacaattataatacaactccgaagagctactcaaatagtttccgtgaaaacttcgactcggaagatcagaaatatctggaatcaaacagtacttccgattatgacggtagtttccagtacggtaatctggaagccagttacgaaattgatacattacgcctgctgactgcttctttcggtatgtatggaggtagtaatgataataacagtgacggactgactacgatgtggaatgcaaacagagatgtgttggcttatcaatatggctctctgagtgatggaagcggttcgtggtattcgatgcggggtaatgtcgactaccagcgtacgtctaaaaagaataaggaccgtatgattactctttcctacaagatcagtactcaaccccagaattcggattactacactaagtatagagatataaaggatccttttgaattggaaatcattgagaagttcctattaaacaactctcactcggatggaaaaacgaatactactgaacataccttccaggtggactacaccacccctatcggaaagttacatacgatagaagtaggtggcaaatatattatccgtaataatttaagtgataataagttgttcgaagctaaaggggcaaccgacgattatgaatacaacaacgaccgtagcagtaagtacaagcatatgaacgacattcttgctgcttatttaggatacactcttcgttataagggcttctcttttaaaccgggagtacgttatgaatataccgctcaggatgtaaaatatttggctggagctatcggtccggaagcggatttcagcaccaactataatgattttgttccatctgttacgatgggtattaagattggtaagacacagaacttgcgtggtggttataacatgcgtatctggcgtccgggtatctggaacttgaatccttattttgacgaccgtaacccgatgtttatcagccagggtaattcgaatctggaaagtgaaaagagccactcgttcaatctgagctatagtatgttcagtatgaagttcaatgtgaatgtttctttgcgtcactcatttggaaacaatggtattgagcgggtgagccgtctgatcggtaaaggcggtgaggacttccccggaggacatcatgctcccgaaggtgcattgtacagcacgtacgaaaatatcggtaagaaccgtaatacaggtctgagcctttatgctaactggaatgcttctcccaatactcgtatctatctgaatggtgatggtagctacgctgatattaagagtccggcccaaggattacataattatggatggagcgcttctatgtatggcggcattcagcatactttcccattgaaaatacgcgccagtctgaatgccggaggaagtactccttacattagcttgcagggtaagggatcgggttactattactatagcctgagtgtgaaccgttcattcatcaaagatcgttttacggtaagtgcttatgttagcaatatcttcgagaaatatcgttcgttcaacaacactactatcggtgaaaacttcttgtctaagaatagcagccgctatccgagccgtagctttggtgtcagcctcagttatcgtatcggtgagttgaaagccagcgtgaagaaagctgcccgcagtatcaataatgatgatgtgaaaggtggcggtggccagggtggtcaaggcggtgctaactaagagtcaggacttctggtaaagataaaaacagaaaggtgtagctatccgcagtggtagctacacctttctgtttttgaatggggatgtgtcattattcaccacagagtaatacagagtcccatagagcgaacttgatctattgataactactgaatatttatctgtgtaaatcagtgtaatctgtggtgaatacgagttccggcacaccccatttcgtccggttgccggtttataatgaatgatctgccggcacctctttccccgaccaggctttcaagttggtccattcggcgggaggagctgaccaaaaggcatcgtcagcaggtaatcccagtggtaagaacccggtcagacacagataagtacttcccgtattgatgtagctttccgacattcttatctgattaccggagaaacctatccttaaccaaccgtttgcgtcaaaattgtcggctgaccgaaactgattttcaatgaccttggtcattgcacaacgtacttgggcgggagcaatatgttcgggaagcagatgtagtagggcagcttgtcctaacgcatgaaatactccggtacgatacacgatagaccgtccgattaccggataagttccttccggtgaaataaaccgttccagctgttcggcatagcgttccaagcgtttctgctgtactttcagaaattcagctcccggcatccggtgcttttgcatgacgattaatatgtcagttagcatggggtgaatcacaaagctgttgtaataatcgagatggaagtcagccccgtcaccgtattgggcatctcccttataccaaagatccctgaacttgcgtactccgtagttaaggcgtaccgtatcgcactcaccggtgaattcttgcaatgcagcctctatgatagaggcaaacagcaaccagttgctttcgttgggtttaatggcacggcttcgcttcaactccgtcactacccgcttgcgggcaggtgcagagagattaccccataactgtttgggggcgcgcagcaatccttctgccaggaatgcggcatctaccaagggctgcgaaggttctccgaaaatcaggtaatcgggtgaggaggggttaacggcattgctgattccttttacagtcagctcgatgtatttcttgcgtaactgtccttccggcgtatcgtccgctcccaattccagccatggagccatgccgcaaactgtacgtcctactgcttccagataagagaaacgttgccggtcgggggcaagcgattggtatggcattcttttcttcagtgtttcgttagccagattactgagtaccggattggccaggcggacaagtgtctttacccagacatcccggtcggcagttcctggccggcactgtgcccaaagacaggggactgccggccatcctccggccagcaatccccatacaataattaagatgatccgtttcattgaagcgatccgtcttctttatattccactaccactacgtccgtaagtggttttttccccggagtagttacacggatggtattttctcctgccttcagtttgacacctttccatacaactgttgagtaagtgtctgctttttgtttgccacaactgacaccgtttacaaacagttcggcttccggggcagtggtgaatgccatgaaagtctgctccggttgatagcgaagcctgcatcgcttctctgccaagtaaatcatcggctcctgtttgttccagtttgctttatagaagtagtaggagtctttcttcacctttcggtcgaaggtgacgagacctttgtcattaatacccgggcggtcaccttccgtacgatgggcagcgccgaagtcgaacatgttccaaacgaatgtaccccatacgaacggacgttcggctatgattttccaattctccatatgatagtaggtctgccagttttcagggtgccaccatcccgaagcggacggttgcctgagcgagtcctgctggtggtagacactggctcctgccccgtattcactgatgccgatacgtatttcgggatatttctcgtgtgtacggtccagaaaggttgccaatgttttcggagtacttccataccaaccatcgtaacggttccaggcaatgttatcggtaatgaagttcaaatcaccgttctggttgctggcggaagttgtcggacgggtagggtcttcctgtttcgccagtacattcagttctttgatatactctacaggattgtccccgacttccttcagttcattgaacaggccccagaagcagatagagggatgattgtagtgctggcgaatcagttcgatgagttgctgtttgccattctcacggaaggaaagctggttgacaaaacctttatccgcatatcctccgggaccgacaaacggaatctcagcccaagtgacgataccgtgccggtccatcaaatcgtacatataagttgcctgcggatagtgtgccaggcggatggcgttgactcccatctcgcgcatcagtgccacatcttcttcatgatgctggggacggagtgcgttacccacttcggcacgatcctgatggcggcataccccatgaagtggcagatgcttgccattcaggaagaatccttgagccggatcggtatgataatagcgtagacctaatggctgtgttacactgtcgatctgtttaccgttcttgtggaggctgacagtgacctgatacataaacgggtcttcacaaccattccaaagacgtggtttttgaatcagtaaaggaagctgttcctgaatatcggtcccctgtttcagcgatatgctccggttttctttgcaaatcactttagagccgtccgtcacttggatccgaagttcggccgctccatcggttgctcggttggacaggttcactttggcacatacttttgcttcttgggcgctgacggcttcctgcaccagataaactcccggtgaagcataatccagaggcgagatgcaagtctcgtccgtaatcagcagatgtacatccctgtagattcccccgtaaaaattgaagtcgcctacgagtggcattatgtccagttgctcaccgttattggcacgtaccagaatggagttcttttctccgtatttcactaagtctgtgatttcgaatataaaggctccgtatccgccccggtgttcgccaatgtgtttgcggttgatgaacacgttggctacactgttcacaccttcaaagcgaagaaacaggcgcttgcctttccattcgggacgaacatatagagctttttcatagttcccgataccccgtttgtagtctgttttgccggcaagcgcatcttgtgcattccaggtgtgcggcaggtctaccctgcgggtgtctccctgtacctgatgcgagaaacggaaattccagttattgttgagtagaatatcctgacgctgggcgtgaagggagagagagaagagaagtaggagaagaaaggggattaaatcttttcctcggcccctccgccataaggagggaaaatagttacatttctgctgtttcatatgttcttgattatgtattgattaatgatgttattattgagatcatctgtatttccctatccgttttgtaatacgtccgctttctccggtccgcccggttcgggagtttcttgtgggtgaatcacatcgaaataatagatgccttgttccttcagatagtccaggaaggacggcaaccgcatgcagaaacggctccagtcttttgcgccgggtgaagtccatgccgattctgccaaggctatcaaacgcgggaaggtcatgaaatccagtcgtttggcatccgcgatccgttcggtccagagtgtgaattgcatacccagtatctgatcttcgtatcctttaaagagatgactgaccggttcgggaaaagcgtagacatcttgcagcggattgaatccatcccaatagcgtcccactttatgtgaggcatcctgtacgaaatcgccatacagcggacggcgcggagtcagcactacctgatagccctgttcaagtgctttcagcaactggtacttgcggtcgtgacgccaccacattaccagtgctttcgagggggagataccggcatccactatttcgtcccaaccgatcatcttcttgcctttggctgctaccagatcggcggcacggcggatgaagtaatgctccagtccggtttcattgaccagccctttttcctttatgaagttctggatatccggatctgtgaaccagttctggttaccatagtgcacttcgtcacctccgatatggatatagggagccggaaagagagcggttatttcatcgagcacatcgctgataaaacgataagtttcttctttgcaaggatggaatgtgaaatgcttccagcgtccttcacctccccccgatacctccggataggcacggcagactgccgtggcatgtcccggcatatcgaactccggaatcaccataatctggcgttcggctgcataggccacgatctcccggatgtcgtcctgtgtatagaactgcggagctgctttggcatcatgccaattaccgacggctcctatctccgtcagcttaggatattttttgatttcaatgcgccatcccggttcgtctgtcagatgccagtggaatacattgagatggagcctcgccatcaagtcgaggtattgttttactttctctttgccgaagaagtggcggctttcatcgagcataaatccgcgccatgcgtagcgtggcgaactgtaaatccggcaacagcggattttgccccgtccgtgctgtgccagttgtctgatggcctggccggcataaaatgcgcctttctcagaagtggcatcaatgaagatagaatccggcgtaatttccagttgatatgcttcatccgaatatgctgtaccgatggcaggcagagacttagagatagtagttcgtacacactcagccgaaacttcgtcataagagaatgtacccttatgtgtctctatcgcagaaggagcggggaatagcttttgtgcttgtaagccttgaaaagcaaatagagcaagaagaagaaactttattctccctcttgctgtattatgaatgaataatggtctgttggttcgtttcatcctatgtctttaacttgttagcattcctttttacttaaatacttccattataggccttccgatccatacttgtggctgtttcagtttgaaaatggcagccacggtagcggctacgtcaaactgcatcatgctggcctgaatctcatgccctttcctgatatttttccccgagatgatgaacggagtctccatctccagcattgtctttcctccgtgccctttattgattccgccatggtcggatgttactataaaaatcgtttcatccagcattccggcttctttcaccgcgtcaatcactttgccgatgtatccgtctatttcttcaagcttctggtaataagccggtgtgtcatgtccttccttatgtcctacatgatccggattatcccaagcgataagtgtcaaagccggctttctctctttaatatacttcacggctgtttcgcatagttccgtaggatgtttttcgtagttaatcccttggttgtatttgtttactgccagcgtatctaccaggtatttgatgccgatccattcgtagagagtgccaatttcagctttcgggtcagcttcgcggagcaattggaatacagttggaaaaatgccatctttacttaattctttcgaaggaagatccggagtgcttgaattccaagtcgtgtatccgtgtagctccgggcctgctcccatgaacatagatgcccagttcactgcactggacgaagggagtacagagcgtttggtcagtgtgtaagaaccatcattcattaattgtttgatatggggaatattcgctttctctacactgtaggaaccccagccgtccaacccaatcaagactacatgtttggctttccacttgctgccggcatggcaattgggaactatcgttaataaacagataattaaacaggctaatttaaacacttgtgttttcatgatacttttttataataaaattatttatctaaatcttttctacgcttcagggcttccagaaagtagtagtctgcatagttcagaggtacgtcgatttcactattatgcggaatactgcctacgctatgcatcaggataaaattgccgttagtgcccaatgtggcccgatagtcaggtgaggcgagactatgcatgatgcggtctgcatattccctgtaggaagcggcatcggggacgtcatatgtgctgatctcgtacagggcagaagcgatgcaggatgcggaagagacgtcccggggttcatcgggtatattgggtgcgtccatgtcccaataaggtattaggtcttcgggcatgtgcggatcatttttcatcctattgaatgttttcagtgcctgatccagatatttgcggtctttcgtttcacgatagcaaatagtgaagccgtagatggcccatgcctgtccgcgtgaccaaaccgattcatcagcatatccttgtgctgtttgtttatggcgtacggagccgtccgaaatattatagtccactacgtgatagcaacttccatcaggacggaaatgctcggaaagagtacggtcggcatgtgctacggctactttatggaaagtggaatcaccggatagtttggttgcttcgaacagaagttccaggttcatcatgttgtcaatgataaccggacattcccagcctctttcactttgccagctattaccctttacatcccagctttgaatgactccggcattggggcggaaacgcgtacaaagtgatttggctgcctgtaccattacgtctttatatgcagctgtatcgggagcgagcctcaggccgttaccaaaactgcaattaatgatgaatcctatatcgtgatgccaagtcaggtgctcggccgggcggatggcttcagtatattttctggccagtgggaggtagctggtgtcacctgtcagttcgtacagataccagatgctaccgggaaaaaatccactgcgccaatcggcatatccgcagtaatatacagatccatctctattgagagttacaggattgagacattttccgctggcctcgatggtgtcgatggccaaaccgagttgtgctttggcaaattctacattttctgttataaaagacggtactgtgggtttgtggcttgagcaagccacacatatcattgcgcaggctgctcccaataagggttttaagttcatgttttattgtttttttatggtaaaagaataatttcctgttttataaatgtttgttgctgtgagtgtaatgcgacaaatcgatttaccccatacattggatagccggggatctgttaatgggattatttctgttttcacatcgaacagttgtttatcatattctatgacggctttctttccttttacttccaattgaatttttcccggtatttccgtacacacctgcccccatgtcatgaaattgatttgattgggctgtttggctgtcttcagacggaaagaatctgaaatccgtaattgtcctttctgaagtgaataggaacgtatccatgattccacttctgcttcggccggataggctgtcgctatattggctgtgaatgtgtttttccttttgtcagcttgtacttgtgttgctttatatgttgctccgtatttctgggggacgccattaatcagggggagattgtgataattgctctgcatggtccaaatggtgtagcgatccttgctgaatgtctggcgtgtataagtccctactccggcatcaataagaaaaggagtttggtctatccagaatgagaaggtacctgcgtcattatgattatggctttcgtcgttatatcctcctttagcggccaggaagtttcctttattgtcagttatatagcagaattcggtttccggataccaggagaatgggggagtcagatgtgccgcttgagtttcttttagttcgttcgcaatttttatagcagcaagcgtacggtatatatcgcgtccggaaggaagcttattggtgttaatcatagcagcgaatcctttcatttcgttactgtttacagccttgccataccggaatatcaagggagcgtctccactgcttttcgccgaggcatcagcgaaattaaccacccatcctttgcccacgtatgaacgtgatatatattcgcccatattctttatcatgggattatcgaagatggagacagttcctccggtaacggctgacagtaattccagataatcaaacatttttcctgcggcatgtccccagtaggagggaccttcctcacatgcaccgtcggtatgggtatagttgatgaatttatctaccgaaaccatactgcggtatactgccttcgctaacatttctttatcattttcaagcagcataaaacacattaaggcgttgctgttacaccaaggattccagttgttgaccatcattcccggtttatagtccactgccatccaccagaagtgatcgttattcatgtaaggatccagtatacgctgttggagcgtatgccgtaaacgttcggatatggcaggattgagtttgtcaaattcttgatgcatgtaataataggtccatgcgagtaaagagcccaggtcacctgctgtcaggtctatgatgttttctttaaaatcgggtagtgagcggtgagactgttgtgcattcaaatgggcggctaatgcccaggaagtcatctcgcaggaatgatatacaccgttgatcagctgatcgataaatcgtcctttcccttctgcgagttcagcgagtagcaggtcggctatggcattgttattgttggcgaagggagtttccataacgctacggttgccgctgcgttcaaattccatataatcagtagctttcacaacctgccattgataattcagctgcttctctccgcgaaggatacattcattcttgaaagagcctaaaaaagtgtcccatccggttcggtcggtataggcaggataagtgacccattgttgatttaatataagcacttcctgcaaactgcttacgctggcttgtttttgaagatagttccgttctgtatagctgagggctcttacagtacagcatagcaagagagtgaatattaataatttcttcatcgtaataaaattaagattttaacgtaggcaaagtaacaaaatttattgctatttcatcttactaaatggttcttaatgctatataaattttctattttagttggatatttgagggagtcaatcctcaaaagaggaaaagtcgataagagagtttatttagaactttcttttcagatggaatagagggcgtgtgtcgaaactcatcacagaagacactgagtaacacagagtgaattttaagtcattgattatctatgttgataatctgtgataatccgtgtaatctgtggcgaaaagagttttgacacacccctttggtttataagaatcagtagcttaaacgtatttgtttaattccagcccgagttctgagtcagtgatttattcatatcagtttcatgttttgggattggccatacataatattggtctcctccccatgtataaggataggtgacagtaccccatacatctttcatcccggctgtaccatcagcattattaaacttactttctttccatgttttccaacggagttcttcgtaaaagtcaaccccttcacccgctgtttcccagcggaattcattctggatgcgaatgcgcatatcttcctgtccctggaccatagtggcagtattgctgttcaacagtgcaacaccggcacgttggcgtactttattcaaccattcgatggcctcgtcggttttaccctgctcattcaatgcttcagccaatcctatgacgacagttgcgtagcggataattggcaggtcaatcggagattgttcgcgattggtcatttcacttgaaccttcggcaacaaatttgcggaacaaatagtataaatggctctgggtgtcagtgcgtaagtcataaggataatcggtgtcggcaccataataaggccagcgtgaagtgaaggtgtggtctacgctgtttccggaaccatcatatgtagcatatggagtgatgacagtctgggctaaacgaggatctcggctgtcataagcagctttaatacgggcctcgtttcctgccggcagatagaatgcttttgccttgtcactcagcttttccagacgtccgtctacttttgcttttattttttttaccatatcgtctaatgcctcttccgtaccgtcaaagccgatttcgcgatactgtgcttttactgttgccggatcagtattacgcaagaagaatacttcacggtctttaatatctaagcttgagaaccccggaatgtattcatcccagttaaatttactgccgtctatattttcgtaggtttctacaaaatccacactggccaacatggtgttccagcaagaaccaaatgtagtacggccaccataacggaagctcatggaatttccgtaagtgctgccattgttatcgatacactgcaaagagaagatagcttcatcactctgttcattagcttccttgaagagttgcttgtaaccatcctgaaataatgaatgtcccaattcacctactttacggaaatctgcttccgccttactccattctttggtccacagatagattttgccacgcagtgcataagccactgatttggtgacatgaccccattctgctttaccggcagcgatacggtcggggaaattcggatcgtttattgcgtcggttaaatcttgtatgcagaaattccatatattctcttcgctttcacgtggtttgtctgcttgatcaagttccataggcgtattataataaggaacacccctgaagactgcattcagtttgtaataataaaacgcacgcaatacttttgcttcggataataatttgccttttacgctttcacttatcggtgcgtcgggtagatgtacaatggcatcattggcacgatagatacctgcataatgttgtttccaatagtctgagaatattccggaaccgatagaagctgtaccggccagcagtggataatcgttgtcgcggcaggttgcacccacgctgaatgcctccattagataagcctcttttgccacatacccttcgcgcagggtggcgtagatagaggctactcccatagtacaaaagttttcattactccacatactgcccgatgatgctttatcatatggctttgtatccagtaaatctccctggcaactgcttatagcaattgctgtggctgttaatatgaataatttatttaatagtttcataagatttcaagatttatttagaatgttatattggcacctattgcaattgttctaaacggagaatagcccataccggtagcagattccgggtcttggccttcaaatccggtaattgtcagcagattttcagctgaaacgtaaacacgtgcattctgcatagcgatttttgaaacccagtttttcggtagagtataacctaaagacaggttcttcaatttgatataatcacctttgtatagccataaagttgtatttccatgacgattttgtacatagccgtctatataagccatacgcggatatttcgcattgatgttggtacgtggatcatccggattttcgggattgtagaaataatggttttcggcaatccgttgtgcgatggtgctaccccattctgtagatgcggcattatagccagtggttgctccccagtatatgctgaatccggcagctcccgcccataccatagagaggtcgaatcctttccatgcggcagaggcctgaaaaccgaaattatatttgggcttattggatgttttttggaaagtatagtcgttatcgtcaccatatactccattattattggagtcggcatagatgtaatcaccataccagatcttgtttttggcaaccgtcttgcccggctgaaattcatatccggctgcgatcatgtcttttacccatgtcatatctttttctgtacggatcataccggtcttaggtcctccttgaggatttacgctgccatccgcattgtagtaagagccattgccatgataaacgttccgtaaatagtattcattcatcatgcggccttcaacaatgggggttgtgccaccactggacactttaccgatattatcttcccatttacctccggtcagtttgttactcggatcttctacccatgttctttcataagagccgttataggcatctatattgcttttgttgtatgagaagttgccgttaatggagtagcttacccctcctatgttatcacgccatcccagtgataactcaactcccttattgctcactttggcgaggttctgacggggggcagtcattgttccgaatacataaggaatagttgggcggtataagataccgtcggttttcttctgatacaggtcggcacttatgctcagacggtcctttaataaattaacatcaacaccaaagttgacagaggtggtagattcccattgcagtaagctattggcgatggcacccatatacagtgcagaatttaaggcatttccaaatactgcgttggtggtactgtataccgacatgtattcgtagttaccaatttcagagttacctaatttaccccaagatgcacggattttcaggttatccagccaggcacgggtattttccatgaagctttcttctgagatgcgccatgcacctgataaggaagggaagaatccccaacgatgatctttatggaagcgtgaggatccgtcataacggaaattcgcctcaaataaataccgggaattatatgcatagttcacgcgtccgaatacagaacgtgtggcataatcctgggttgcacctttggtacttgtcatttcggttgcttcatcaaactggttcagtgattcgtcgatcaagcctttctttgcggcatctacagtatagtaattcttgtagaattcctgataacctaacaatgcggatacatcgtgtttctgagcaaatgtgtgatggtagtttaacaggttttccaatgtataagaataattggattcataaccgaaacttgtgcttaattgagaaggaggagtgataccatcgacaattaccccgtcactgaaacgtgtctgataagcgggtactccccattggcgggtttcgtagatgtaacggttgtaattgaagttgaaatcccaacttagatctttaaagaacttgaccttactaaacagggtcgtgttgaaacggttgtagcgtttgaagccatcattccgtgccagtttatatagtgggttattggctgttgcacgttcgtccggacattccgggtagccgaaacttccgttccattcgggataagtaccggctgtagattgtcggaggaaagtattggcattgctaaagtcacccacctcacggtccatttgtgaggcataagtgcgcgtacctaaagtcaaccattgagttgggttggcttcaatattggcacgtacagagtaggttttgttggctgtattgtctacaataccttcattatcctgataacgggctgacaataagaaacgaattttgttggatcctcctgaaactgaaagattatgttcgtgtatcatacctcctgagtatagctctttcagccagttggtatttgggtatgcgatgtaattaggaacaccgttttcgtttactccattgggatcttttgatttctctctccacaaatcgatatacttttggtcaaaaagagttccggagccaacattttcgcaagattcgttcattaattccatataatccgcatagttgctcatagtttctatcatgcgtgtcgggctgttgaaagagacgcgtccactatagtttacctgtatcttgtcgcgatcgccgctttttgttgtgactaagatgactccgttggcagcacgggcaccataaatagcacaagaagctgcatcttttagaatagagatattttctatatcctgagggttaatggcattcaatgaaccttccatgccatcgatgataatcaaaggtgaggcattattcattgtaccgttaccgcgtacccgtagggttgtgttatcctctcccggcattgccgagcctgagctggcttgaagtcctggacttagaccggctaatgccgaagatactgtcgtaatggggcgtgatttagtttgttcttcaaaatcaacggaagatacggcacctgttaaatttgctttcttctgtgtgccataccctaccactactacctcgtcgagtgttttgctgtcttcttccagttggatgttgaaagacacctgattgccacttactttgacttctttattgagatagccgatgtaagagatttgcagtgttgcgttggacggtacttcgagactaaactctccgttcaggtttgtgatgacgccaatagttttattaccttttacaatgacgttagctccgataatcggttctccatttgcatcttttacaatacctttaatcgttctgtgctgttgggggactgctgtgatcgcatctccgttttcaactgtctcttgtgaagaaacagcccaggcactaccgcttaaaagcattattaacgatgtacttacaagtacccttttagaagataagggtagcaaatgtaatttgctttttctcataatactttagattgagttaataaaagtgttaaatacatcgcaaaactacggtaactgatctgatccgatgtgatacttttattctcaataggggcactaattattcagagcctatttggaagctgtcctaatccgtgttttccatatggttttatgtacaaaattttgtgataagatgctaaattgaataggaatcttgggcataatttgttctttttcatgatccgtatactattaaactttacaaaaaacaaatgaaagaatcggactatgtcgtgaagcagacctctctatgctatttttgttcgcagtataggcactaattgttcttaactcagtagaagttccagaagaactttggcgatattacggcaaaatccctcttctctcacctatcatcagattctttttaatccggctatttaaatagaccatgagtccatattgattaaatagtttctttacgagcataaatttactttcagatgttattaacttaggtcatttaagattttcctgtttagctcctttgcgatattccatcggagtaacgttatattggtttttaaaacaacgactgaaatagcgcggagaaccgaaacctaacctatcggatatttctgctacctgcaaataaggttcgttcttcaacatcagtgatgcttttttcaatcggtgatttagaataaattcattgggtgtcattcctgtcaatgctttgaattttgtgtgcaacaacgtccgtcccattccaagttcctgacataatataccaatatcaaaatcctcattatcaacatacttatctaccactttgattactctatccaagaaacttttatctatcggattagcagccaacaggttgacttccgaaatctgatctttagcaaaacggctttgcatcaacaagcggttacggatcaaattattgcaacgggttattaagatttttgcattgaatggcttggtgatatagtcgtctgccccacgacgtagtccttcaatattttgatctacagtgtcaagtgcagtcaacaatacaatcggaatgtgacacaggtttatgttattctttattttcaggcacatctccgttcctgtcattaccggcatcataacatcactcactatcaaatcgggaacttctgcaaaagcctgttttaatccctcctcgccattagctgccgtcaccacctgataaagtgatgaaaatatttctttgagtacatgtagaagttccacattatcttctaccaacagaactttccgtttcccttcccgcccatctatcaagggagtttcgaacatagaatcatccttttccataaagttctcatccggtatggtactctcttgtatcataggctctttttctggagattccagaaaaacgacttcagtatccttttcaaaacaagcacgagttttaggtaacttcacaataaaacagcttccttcatttaactcactttctacctcaattgtaccatgatgtagctgaataatacttttcgttaatgcgagtccgataccagtgccaacatgaatcgctttattccgattgtccgcctgataaaaacggtcgaatatccgctcctgttcttctttactaatgccatttccggaatctttaaccgcaataattacctgatccggcgtagtagaggtcaatatatttatttttcctttatccggaacatgtttaaaagcattcgaaagcaaattaaacagaacctttctcatttgccagtcatctatccaaataaatacatcctgctccagtagcttcagatgataagaaatagacttctgagaggcataagctgagaaagacagatagacctcctccaaaaatgtattcagactttgttccgatagttttaattggatatagttttgatcgaatttccggaagtcaagtaattctgagattaggagtttcatttgttgggcatgcttccttatcctgaaaatactgttgtgcaaagatggaggtattgtattcttctgtaacataagttctacctgacttataatgagagttaaaggagtacggaactcatggctcacgttggtaaagaatcgtaatttagcttgattcatttcttcaatatgttccttttcaatacgttctttctccagcgacatcgccaaagttcttctggaacttttttcgcgccatataaagtaggtcactgaaatgctgatggtgatgtaactgagccatgcccaccaagtaagataccagggagtgctgatatgtatctgtaataagatttcttgtgctttgcgcattttcagcgagttgcctttttggcgtacgtgtagcacgtagtctccaggatcaaggttggtgtatttcaggcttgtttgtgaggtgagtgaccattgcttgtcaaaaccttctaactgatactcataccaagtattattcagtatatccacatagttggaagaagcaaactcaatagtcaggttattttgagcggcatttagatttacttcccggacaaaagggagcccttctgtcagtatacgacttttgtcatccggacttatccgtgcgttgttgacggataaacttgaaaaatagagtttaggtttgggatattctttgttcaggtctttttccagaaaagaactaagccctcctgtacctccaataaatattgtatggtcactacacatccatacaccacaaccattaatgatggatgagagggacagtccgttatccagttcaatggaacggaatgattcggtggttggattaaatagtgtgataccccgatcacttgtgataagtatgttatctgtcgaagtctgtagaagattatagcaataattgctaagtagttggttctgttcgggagtatagttgatgcaggtctgagtttgttcgttatagcaaaaaagtcctgaacctaaagtggcgatataaagatattgattgttacctttcaaaatcttgctgatgccgaactgtccaatggatgcaggcaggctgaatgatttaacttcttcggggtgtttcaggtttatactatataagttagtacctgccgacaaccagagaaagcctttggggtcaatggtgaaagtttgatagtaatatccgtcataaagcaagcggaattcattcgtatcgggattcatggagaaaactccgttgcgtgcggaaacgattagctggtcgttatagaaagatacttggaaaataacatcattgggctcttttttgcctttcgtggagtaattgaggtagttgtaaaaacgtcctgttttgcggtcgagccgggaaagacctcccatatgcgtacctatatataaacagtctcttttagggtcgtaacaaatactcttcagattgttgtggggcagagagttgggtcctccggcagtgtaagtcctgaaatgccccgcttggcggtctaaacatgccaatccgccaccatcggtgcatatccataggtgatgatctttgtcctcggtcatggccccggcgaacgggtagttgagacagtcactgcgatcgggattataagtgtagtaattgaatgtgttgttatccgggttgaagtagttgactcctccataataactacctatccagatagtgccttgtacatcttgatagagcgaaaatatagaagaatggctgagtcctcccgggcgttgttcttgcttgatgaggctgtaggtttgggtgtgtggatcatatttttgtaaaccgtcgaaggttccgaaccagatgttcccttgctgatcttcaacaaattcacgtatttgttcactggaaatgcctttgggtgatgaggggtcataaggaatgcggttaatttgtccgtttcggttgatatggtatagcccttgtgtacggcaacctacccaaagttcctgactggaactttggaaaatacggtaaacatctactttggggatcaggcattgaaccgctcctttattttctgtcgtatataggccttctttggcaccgatataaaatctgttgccatctgtcatcagatagttgatggatggtatacctgttttttgctgaaaatctaattgattgttttggggattgtatcggaaaatagagtcgtgcccggcacaccatatctcaccggcatgagatgttagagcatagacagagccttgacgcagacgttcgaaagtctctttacgaatatcgtatttcaataaagcacgatcaacaattaaaaacacatctccgttttgacttccagtaatggcgctcacctcattccctatcagaactttctgatccggctgattcccgttctggatccatgctttataaaccgtcatcctatcactattgtagatgttgaccccttcacgtgtaccaaaccacattctacccagtttatcttgatagatagccataacagacgattgcgaaagaccttcttctctacctatgtgtttaaaatatccggcgtatgataattgaacgatgaaaatgccgataaaagaaaaggctaatttgtgtttattcatagttattccgtatttataaacgcaaatatataaataacagatagatttagtatatcaactctatgaaaaaagtatataaacagaaataaacctccctactattcaacagatagggaggtttgtgggggaaatcgtaggtttatcggatgctttcctgtattttcggtttcaggatagcggtccagagatcgtagccattctgattcatgtgcaggccgtccggtttaaagatatcttttcgcagttctccgtttgcaccgtacaagcaagaggctacgtcgacataagtgagtccgtccgtcttcgaagcatactctttaagcaaagtattaatgatttcatgcttcggaatcatctccttgcgtgcgagcgaaggcttataggagagaatgaatatcggaatatccggatagtcccgttgcagccggttggtcagtaaacgaaaaaagtcgaatgtttctccgacagtcagatcttcgggggtacctgcaagatcattttctacataaaccacgatactgcgcgggtgatatccccgggcaatcacgtcgtaattataaagcatgtctcgtaaggcggcaccaccgtatgaacggcggagaatcttcagtggggccatgtcccggtaaatgttatcccacaagttgatggaagaactgcctaaaaagagaacgtcgcaagaagtatctttcaatgtccggttttctgtttggtaccggtctatttctccttggtatcgggttacccatgtaaccggatccgtgtggcggacaggaagatattcgctgaagcgcacagaatcctgtggcgtttgtacctctgctgcaagagtgttgcagcagaggaggacagtacaaaaggtgataaatattgattttatcatttatttctttacgttaaatccaagtttcttcaatccgttctgcacgtcgggatgactcatgaaaagtttccatagaagtccggtccggtagttttctatcattacggctatcggcccttggtcgatggccagatatcgcttcggataccagtccgcggtttcgctgaaggcatcatagaatccgtaaggaccgaataccttatctcccatctgatacagatgacgcatcacttgcagtgactggtccggtgtatagacgatggaagagagggcggcggtgggagagatcactccccggtcatcacgttccaacgggccgtgggcagcatatccatccacggaataactggcggtcagcccccagcagtcagccccgtaacctttataatgtttggggttgcggatgcaatattcacggtttaccagtgtaagatttcgcatctcgttgaagtagctcgggcaatattcatctttcaaacccaccggatcgagtccgaggaaggaatactgcgcccagaacaacggaccgacttctccaccctgatagcggagatgcagttcgataccctctacccggtgtggagaaacaatcgcgccattctgtgcccatccttcatgatataccgcagccggcactccatgagtaggagaagcagcggcaaggatatacataatcaggcattcattgtagccgtgtaccggaaagttcatttcccaaccatattccggactccagtgccagtaaagcacattttgcccgtcacggcgataccagttccagtctacctcctgccatagtttatcgatacgtgccgcaagagctttctcttcggttgaacctcctgcatagtattgatgtacggccagcaaaccttgcatcaggaaagctgtttctaccagatcgcctccattatctttttgtccgaaaggttgcacacgtcccgtttcaccgttccaccagtgtgggtaagcgcctttaaagcggtccgccttttccaggaaacggactattttctccatgcggcgcagcccttcttcccggctgacgtatccacgatcgatacccgccagtatggccatgatgccgaagccgcttcctcctgaagtaacaatctccggacctccggccggatattcgccatccatatgatagcgttcgcgtgccagtccgctattgggttcggctgcttcccagaaataattgaaggttcgtcgctggacggtatccatcagggcatcgtctgtcagggtagcggcagaagaaggtttatcctttggcttgcaagctacaagaagaaaaagagcgaagaggaagaagaggagcttgctgttgtgagtgacaagttgggtattcataatgatttcttgtttgtaatggttttggtttcaccacagattacacggattttcacagattaatcatttatcccgttgatatttaagattaaaattctgtgttaatctgtgtaatctgtggtgagattaattcatttctattcccttgtgtatccgattcaacgcaacgtgaaccgtgccgttttcacgttctggctgtcaggtcctatcatcacatcgaaatcgcccggttcggctacgaattgcaggtcggcattgtaaaacttcaacatttccggagcaatcgtaaaacggacagtacgcgactcattgggctgcaggtagatcttttcaaatcccttaagctcttttaccgggcgggtgacactgcctacgagatcacggatgtagagctgcactacttcactgccggcacggtctccggtattcgttacggtgacggaggctaccaactgattgtccatcccgatggagggttgacttaaagtgacatcactgaagcggaatgtggtatatgacaatccatatccgaacggataaagtgcatcattgtctacgtccagatagttgctgcggaatttctcaaaccatttgccttctttgagcgggcgacctgtatttttgtgtgcatagtaaagcggaatctggcctacattcttcgggaaagtcatggtgagtttgccgcttgggttcactgctccgaacagtacatcgccgatagccaagcctgcctccgaacctccgaaccatacgtttaagatggcgggtacattctcctgctcccagttcagcaccaacggacggccagtgaagagtacgagaactaccggcttgcctgttttcagtagagcttccaggagtgtgtgttgtacgtccggcaggtcgaggttggtacgactgctgctttcgccgctcatttccgatgattcgcccagcgcggcaatgattacgtccgactgtgaagctattttcaacgcttcgtccagcagttgcttgtcagtacggttgtcgcggttcagcgaacggccaaacagggtggctctttcctcataggcagcatcgcttatcaggttactgcctttggcataaagaatctttgcctgattgcctacccactcggtcaatccctctaccaaagatgggctcttgtccagaactgccgccacactccacgtacccggcatattcgagcgggtattggccaagggacctatcactgcgatggtaccggtgggtgagagagggagaaggggagaggaaccgggagagagctgtccgtttttcagtagtacgaaactttctccggcaattctccgggctacggcacgatgctctttggtaaagatgtcacgtgccggacgtttcaggtcacaatatttataaggattgtcaaataaccccagtttatatttggcttccagaatgcggcggcaagcggtattaacggtttctaccgatactttgccttcttcgatcgatttcttcaatgtgccggcgaagccttcactgaccatgtccatatctactcccgcattgatggcacgtgccgatacggtttgcaggtcgccaatcccgtgttctatcatttcagagattccggtgaagtctgtcactacgaatccgttaaatccccatgctccacgcagcacatcggtcatcagccatcggttggcagttgccggcacaccctccacttcgttgaatgaagccattacactgcctgctccggcttcaacaccagcctgataggggagcatgtaatcgttaaacatccgttggcggctcatgtctacggtattgtagtcccgtccggcttcggctgccccatacaaggcaaaatgcttgatacaagccatgatctcatcgttacggcgcatatcctttccctgatatccgcgtaccatggcttgggcaatctgagctccgaggaaaggatcttcgcccgaaccttcggatacccgtccccagcgtggatcgcgactgatatctaccatcggactgaaagtccacgagatgccgtcagcgcttgcttcgatggctgcgatacgtgccgattcttcgatggccggaatatcccaggtacacgaaagccccaatgggataggaaagatggtttcgtagccgtgaatcacgtccataccgaagagcagagggatacccaggcgggaattttctacagccagacgttgtacgtcacgaattttatccacccctttcaggttgaagagtccacctacttcacctcgctttatctttgtggctatgtcactgcttttagcttgtccggtggtaatttcacccgttaccggcaggttaagctgccctattttctcttccagggtcatccgtttaagcagatcgtcgaggaaacggtccatgtcctgaggagatttctgagcttgcagccccaacgggagtaaaagtgcaagcagaatgagtaaagaatatttcttgttcataactgtatatggttaagagttcaccacagattacacggattatcacagagaggagatccattggattgataatctgcacttaatatatctatgataatctgtgtaatctgtggtgaaactctgagattaataatccgggttctgtaccaatacgcctttcgacttgtctatctcgtcctgtggaagtggtagcaaggcattcttgggttgataacccgttttgccagcagcatgtagcacttgcgaagcgataccccagcgtaccaggtcgtagaaacgtcccgattccaatccgagttctacccgtcgttcatgccggatggcatcacgcaacacggtctgatccaatgaagtcactttgggcagaatgtccggattgttgccacgggcgcgggcacgtaccatttccagataacccgatgcttcgcctgttttacctaactcattagccgattctgcagccattagcactacgtcgccatagcggatgatacggatgttcacccagaaaccatgacgggtaaactcctcacgaagtgccgggttggtataagctttcttgttaaagtaagccccgtcggcctgtgataccggagactctccataaggtttgttggtattctcgggagtgatcggatcagtatccgaacgacggaagtaaagcagtgtagcatctttgcgcgggtcgcccggttcgaacgcctcacccatcagctcggttcccatatgccatccccagccaaggtcccattggccggagccgcgtacaccttgtacctcgcagaactgactgcctattttatcacttgcaggcagggcggcagtcgatgcacattgcagctcaaataccgactcactgctgttttcgccatcatcggtaaagataacgtcataaggggtgtccagattatactgtccggaattcattacatcggttgaggcagtatacatgttctgccagtcgttacgcatcatatacgtgcgggcatgcagtgcacgggcacttccccaggttagacgtcccaggtaggcagactgccattgacggggtaaaagcccttcagcctgtgtcaggtctgagtcgatctgtttatagatctcttcggcggtggtcttcggtacattggcttccgaggcgtcgttcactttgaaagtgaccaacggcacttcgccgaatgcacggaccaggttgaagtaacagtaagcacggaagaaaagagcttctcccttattccggagatcattttcttctgtcaggttacctttctcgatggtttctatcacgtcgttgcattgatagatgatagcgtaattctggctccagtaggctttgatcagtccgttattggtattgtactggaaatcatcgtacatggcagcctgatcggcaccgtcgctcgccgtacttcctttttccgaatcttccgagcggaaatattcgatggcaaaggccgggatacctgcggtaatgttatagttacgcatcatggtgtagatattgaagacttttccttcggcaagtgctccgggattatcatcttcggtgaactgcccttgagggtgacggtccagaaaatcgttgcaactgctgaagctcagagccgatacggctaatgcaatgggtaggatgtatttatttagtttcatactctgcttcgttaaaatgttaagttaataccaaatgtatagactgccggtaccggatatgttccgttatccactccgaaggcaatggccgatccgccgatttccggtgtatagcccgtgttatgcttccacgtcttcaggttttgtatgttgacataaaccttcagagcctgcatgcgtattttcgccagcaaggttttgtcgaagttgtaagccagttggaggttacggatacggaagaagctgccgtcttcgatgaagtactcggagttctcgctgttgatggcatgttttgtattcagcaggggttgcgtgttcgatgtgccttctccgtgccagcggtcgagacgttgctccatataattgaactgtgcccagttataattgtcccaggtacggtaaatctgattgccgccttgtcccatcatttccatgctgacttcccagttcttatatgaaaggccgaggctgatgccgtatgttacgtccggtgtcggatcaccgatcatcgtgcggtcgtccggtgtgatttttccatctccgtttacgtcggcaaacttaaggtcgccgggtgtgacggttgccagtgtattcgccggtgaagcgtcgatctcggcctggttttggtaaacgcccgctactttgtagccgtagaaataaccgatcggatagcctgccattgtgtagctctggcttttgtcgcctgcgatgatggagtatccttcctgtaccagactcttcactttgttactgatagtggtcaggttcgcgctgacagaatatccccagtcgccgatctgatctctccaggaggccatcaattcgatacctttgttctctatttctccaaggtttccgatacccggtacggttcccgacaatcccggtacggtagccagcaggtctttggtattctttttgtaatatactccttccagatggaagcggttgcggaacatattggtctcgaatccggtttcccatgcttctactttttcccagcggaggcgcgggttgggcaggtaagccagttggtaccccggatagatgatagccggtttgccgaatacggcagcgaaagcattctccaacaacggttctgccggataagccctatccatattctggttacctaatgtgccccacgaacctttcagtttcaacatgtccagccatgtgatgtctttcatgaactcctcttcagtcatcagccatccggcacctacagagtagaagttctgccattggttgcccgtgtatgcgaaggccgatgagccgtcacgacggaacgagccgttgaacaggtattttcctttataattatagatgacacgggccagcatggacacggtggtgcgttcccactgtgtacttccgttggtagcggtagccagatcgccaatgctgacgaaccatttatcgggattattcggaatcaccagcccgataccctgtccgcgcgaagcatccagtccgctgagtgaattgtagtaggttgtgaaaccggcagtagcggtcaggttgtgtgtaccatcggcaaaactgttttggtatgtcagcagatagtcactctgcactttggtttcgttttgtttgttctggctcacttccgtctttcccgttccgagtgtagccacattgccggctacagttgcgtcatatactttaatgatcggtttgtaagtccggctgtcattggtggcataatccatggagaacattgctttgaatgtgaaatgcttcaggaaatccacttcaccgtaaatgctgcccgatgcacggtaattgatggcgcgggtggtgttggcacgcagatctacgtcgaccaacggattggtcatctgtgctttctggaattccggcaatgaagtatacagaccgtattcttcgttgtaaaccggagctacaggagtagtgcgaattgcgttcaggaccgttttgctgtcggccgggagcattcgtgctccgttgaactgaaatcccactttgatatctttggtgatcttataatcattacttgcattgatcgtcactttgctatacttctcatgcttaatgtttccctgttcgtgcgagtagcccacaccgagatagaaactatgtttttccgaagcacctgtgatactgatattattgttcgtgatgaatccggtctggaatatttcgtcttgccagtccgtatttgcgttccagttgctgaagtcgaatggggtgtttccctgattcgccatctgctcgttatagagttccttgaactgtggcgcattcaccattttgattttgtctactacggttttccatccgaaagaggtgttgatattgaccagcgtctggccctctttggcacgtttggtagttacgatgatcacgccgttggcaccacgtacaccgaagatagccaatgaagaggggtctttcaatacttccatcgattcgatgtcttccgggttcaggaagttgatattgtcattgaagagtccgtctacaatatacagcggcttgtaaccattgatggagtttgtgccgcggatacggatttcgggatcggcacctgcctgtccggaattgacaatctgcacaccggcaatctttccttgtagggatgatagtgggttagtggccggtttgttggctatttccgaacccttgatgttggtgatagaaccggtcaggtcacgtttcttggcgctaccgtaaccgataattactgtttcggcaagcatttgggagtcgtctttaagcgtgacattaattacagtctgctgccccactttgatttcctgcttttcatatcctacatacgagaatacaagcacatcttcaggggtaacagaaatggagtatttgccattcatatcggtgatggctccggtagaagtcccttttaccagaatagatgcgccgatcaggggctcatgggttgaatctgtaacagtacccgttactgttttggtttgcgccatggctaccgatgcgctcagcagtaggcacgtcaggacaaatacacttttcagccaggaggctctcttctgccgaagaagtcgtaaaggtttagtcttcattgcattaaattttaccattgtataactattttgatttaacacaccttctgccagctctctttcagatactcgatagttatatcgacggcaaaagtatccaatgaaacaaataaaagtcgaaaaagatgtgaacagatggaaactccctgcacttttaacatatatcggacttggaatccgacaaatgtagaagaagtttctagtatgatatatttaccttatgatggttgttgaattctatataattgtatggaattatgtgctttaattaaagagcttatcgaattgcatctattatctaattgttaattgtctaggctggataaaataaacaatgatactagaaatctctggaatagcctcgaaaaacggattgggattatgacattccgaatagggaaaagcgggagctgctcgaaattgattcggttagaatcgtggggtagcaagtttgtgtttcgggacatccgaaaccgcttgccacccatcccccgaatatcaaggggcggcatcccgttggtctatatattaactatactgacaatacttgaaaatggaacataaggaagataagaaacgtaacaaaggcggtcgcccgaagaaaggggctaccgagaaactgacataccgtgtcgcggtgaagctggcggctgccgactatttccgtctgctgacacaggcgtctgatgccggagtatcaacaagcgaatatatgagggagtgtttccggaacggtcatgtgaaagggcggttatcggaggaacatgccgtccatgtgcggaacctgtgcggtatggcgaacaacctgaaccagcttgtacgcaaggcgaatgcagggggcttctatgaggaacgcaacgactgcaaggtggcggtggcaagaatccatgaactcttaaccaagattgggatatgatggcgaaaatcgtacaaggtagtaatttcaagggtgtggtggactacatccttgacaaaaacaaaggggtgcagttggtggctcatgagggtttgttcatggaaaataaagacaccatagcaatgagtttcaacatccagtcgcagatgaacggcaaggtgtcaaagccggtcggacatatcgcccttagcttctccaaagaggacgaactacggctgacaaaccgcttcatggcagggatagcacttgaatacatggaaaggatgggcatccgtgacacgcagttcttcatcgcccgccacttcgacaaggagcatccgcatgttcatatcgccttcaatcgcataggcaatgacggcaggacaatatcggacagaaacgagcggttacgcagcacccgtatctgcaaggagcttacattgaaatacggtctgcacatggctgatagcaaggaaaatgtcaagcgcaaccgactgaaagagccggacagaacgaagtacaggttgtatgacatcctgaaaacagaagtcggcaggtgtggcaactgggatgtgcttgtcgccaacctgaaccgtcagggggtggaagtccacttcaagcacagggggcagacagacgaggtgcagggcgtagtcttcatcatgaacggttaccacttcaacggctccaaagtggataggcgtttcagttattccaagattgatgcagctttgcgacacaataggaacgaggaaggtatgaacctgatgccgaaaggctatggaatggatacgccaagcgcaacttccgaaacagcaagaggtgaacttttcagcggttcattgggattactgaacggtaacggttcttcctacaacgctaccgatgcggaagccaatcaggagatggcggagatattattgcgcaggaagaagatgcgcaaacggggaatgaaactttagacgaacaattgcgacagcattcaagccgtcgtaattatgccttaattactttcaactatttcagttttcggggtggttttgttaacctgttgctgattcatcattatcataccttgcacaacattcgctaaattatgttatgcttgaatatttgtaaaagattcatggtcatagaataaataattatcccaaagtccaatttctatttctctaatcaaatccttgattttattcgaatcagcccgtccgttttgagaaaaatagtcagtgtttgctaattgtgttctaagtactaatattgtgtgaagttctcctggtgtgaactgtttataccagtctactggattcacaattgtatttggtttttctttctcaacccaacttttcgcatgaacttcctcaacatatttcttgcccacgtttctaacagcattaagtctaaggttagtagtaaaatatgattctatatcagtaaaaaacaggttatcgcaattaccattatcaatttgcacaatcattgctataatttcatccttatctatggtaatatccttaaatcttatgcttttaatatcaaaagtatcttttgttggaacttcaaatggaattccaagtttgtgcaaggcaacgacaacagctctcttttctgaaatattaagttttgtattgaactcatttgctgaatcagcataatttttcttatgttgagcatattctttaaaaattcccaatgctttaatagccattgaacgcacattctgaattttcttctcttgcttccaatgtaagaaataagaaccaccataagtaccgattaaagcacctatggctccactaataagcggcaacaaccaactccatatattgtatgtttcctgtataacaccagctgtttccataattacaaatatttatcaaggattatctgtttttcatttgccgcatttttgatggttgtgcacgcattatttatctccatttccaatgcttctatctgagacactatgcgtttttgttcattaatagatggtataggaatcctatatttcaaaatatcttccttattgcctcgtggcatcttaatgccctttttaccctccattacgtagtcaaagaaagcatctctacgaagcatatagaagatatacttaggaagatatttacttgtatcagcagacctaagcacgagaacatctttcgagcatccacccttcttgtcagcaaaccaaatctttttaagatatggacgaatatttgaaatcagtatatcctctggcttatattcggtaatagatgatatattcgcacccccctcaaatgggataataccaaacttgttctgaagcatattgtcggttgtgatatatgtttcagactctatatcactatacttaatagacttggtagtaaatggggcaatagtatttagcatactatctgcaaaattaagcgaagatagcaaactctctatgtttgtttcgcactcattaatctgcagcatagagttcgaaacagacttgtcaactttgccaatttcttctacaatctgtttctggacatcaataggaggaacaggtattttgatattacctattatgtcaagtgacaattctatttgtccactttgtcccaatgccatattttcaatattgtcgaatcctattacacccaatacacatagagcatattcgggtaaaattaagttttgattaggcctaaaaatagtaatatggctatctacgacaaaatctccatcttcaccaaagtatgtaaccctgccagcagttcctacacctgttgaatttatcaacaaatcacctcttacaagttttctttcatcaataacgaaagtttcatctacataatgtttttcagagaagtcaaaatcaaaccaacctctcgcttgcccagattttattatttgaatctttgagttaccatatttggcagatttccctcgtttaagtaaaattgataggtctgttaattttagttgattatacttactatcgattagaacttttttttttgttgtcaacgatatactcttctcaaaattatcacgatcaaaggtgagcatatcaatcaatgatacacgactaatatgcgattgcatactttctgctataggagagatgtaatctcccttaaaagccctatatacataagtacttgctttcttaggattgtcgtatatatttgcatcaaaaagtttagtacactcatcaatgttcttacctctttgaatggcatgaataccttcattccctcttcgatttgagaactcataacccaagaatttcttttcaatatctttttctccactcttgacaataactaccttttgggaatatgccaaaacaaagtacaatagtttctctgcttctatacttaggatcgcctcaaacaactttgcatcatttcttgcagagattttctttttgtactctgcatatatttcgtgtgcttttactttatcatttggcgatttctgtaacaatgtaacataatcagtataatcaagtccctcccaaacatgagctacatattttgatgcaggggtttctataccattaatagttacatcattcaatgtgcggaaaaacgtatcaactgcgctctttgtgttggctgcaaaataattatctctacggcggaggaataaaataacagtatttgtattggtagccataaaggtattactacccaattctgctattgcaacaatatcaaagtattgcaagataatttcacgagccttcgtatagatacccgagttgctcaatattgaacttggaagaataactcctgctataccgccatctttaagtaactgcttcgtacgctcaacaaacaaacattcaatttcagagctattatctgtcaatgagttatacaactcaaaatcttgttccgtataataatcacgagtggtttgacggaatgatgatactgagtatggagggttactcaacactatatcaaactgctgattgtccttttgaacatcatttactttcttgcgcagtttgcccttatactctttgttattgcagaagttagcaagtccatcgctcaatataacattggctaaaccatcaccgtgcaaatagcagcctaccttaccaacttttacaagtcgatagtccttttcaataccatatacatagtctgttgcccaatcgaaatggcaattctgccaattgataagatgctttcttgtctcttcaatatatttagagatatcacaatcgtttatgatgtcctgaatttcgtgcataaactctgtgataaagtgaccgctaccagccgcatagtcaatcatatatggcaaaatttcgccatctttacgagatagtttttctgccataatagaatccaaaggaagactctttatgataaattgtgcaataggtacaggtgtgaaatactgtccagtctcctgtttgagaccggtagtaagaagtaattcaaagaagtccgacagatattgctgacgtttattatatctgattctataaccttgaatcagctctaccacttcttttacgaccttcgcattctcttcaaacgaagcattgtcatacacctccttgattgcgaactcattattcttttcaagacgaagtttgtttacctctcttaaaagatactgtttagtatcttcattcaggttagcacaacgcttatcaaagtcctcattgttgaaatcgctaacagttctatccaagaactttttcatacctttgctataaaggtctgtcaagcgaagttgaaaatcaacgtggttatctcgtccttcaagccattggaactttaattcttcaccctcacccgtagttgtttcatcataaaccttacacaagaagagtgtaaatatcttattgaaagcattgcccttgtcagataccacattgtggcgcagtatttcaaggaaacgattgaagataaagcttgaatcctctgctttaatctcctttaactgttcctttgttaaagccttactttggaaattatatggttgtacccaagaatcgaagataccattatctttggtgagtttattccatttctcgtaaatgtctttcacatcaccattacgataatcatcttcaatctttattatttcattaacatatataaatttgcttcctttcaattctgatgcataaagcattatcacatccgccttgccaccagataattgaaaataagtaaataattgacctccgtccttatggattttagctaattccttgttatactctttgccataagttttgcattcaataagcatatatggtgtggcaccctcacgattaacacaaatatctaatcgcccagatgtgccatgtccagatggccaagtcttttcaagaactatgctctgaggtttatatcctttggtaagtaatctatcaacacattcaagcacgacaaaattttcaggttgtgaaaaattttgtgtagttttactttcggcgataataccactaccgtagttaatgctttgtttttcaaagtcaatctctatggcataatcaacatatattttatgataaatgccattcgtcccgtttttggggacaaatcctaatgctgtaatatgtttcttaatatccatagcactcctaatctatttgcaaagataagaaattaattagagattacctcactttggtttggatttctcgggaaaaataatatagcaaactttggatgtggtaagctctattggagtggattttgaaaaatattacacgtctgtttgatgtgtttttgatttttattactacttttgcattaagacgagtgacaatgaaagcaactcacagcaaagcgcagaaatagatacggttgccaaatcattacctcttttttggtctttcttccgaatctcctatgtctaaggagattataaaagtcttccagaattacgaaaaaaactttttcatgatagatggtgtccaaaatggcgaaatctctattatcaactcataaaaaactagttatgattaaaaaaacgattttactgacaatgttagttggggcactgtttgcttgtgatgataagtcctcgataatgcttataccagtattttccaacgccagttgacaccagcagaagtgactacgctagccaacacttcctttgcggcgacaagtggaaaagggggtactatcagcggtgtgcccagctctgcacagtatctctattttatggctaatatcaaaacagatgtaggtcaggtatttcccgctgtcgagggaacgacaagtgctgatgccagactacgcctgaatcgtttacaaggtacagcacccagtgactggactgccaatgctttcgtagattattgtacgcctttggcttccgcattgagtttctatccggatgtaacgatctcaacaccgagatatccccgtatgagtgagtaatattccgtggcggctgtcaataccttaatagatttttgatagaagttgtatgttttatatatgactccttgaatggaccggccataaacaattcgcccgggtgatattttcatcacccgggcgaaaccgtttaaatttgtacttcgatattcagcttaccgccaagcccccgttcaactatatctatcagggtttttagtgtcaagttacctccgtcattctctactttagagataaacgtacgctttttatcaatgcgctcggccagttgtgcctgcgtcatttctttcttctgacgggcattgcggatttgaacgccaatacacaaagcttccaactcacgttcaaaacgatcacgatctggtgtaccttttacaccgaaatactcgtctttaatttggtctaatgatttgagctccatttctttccctcctcttttttttctgcataatactcagccatcaatcggacagctctgtcaatctctcttttaggggttcgttgtgtctttttttgaaagcccgaaagtaacacaactaacttcccatcatcaaaaaaacaaaatacccggaatatatcactacccagggaaacacgtatctcaaacaatccgtcagtgccttccatatatttaagatacattgtcggaatacgttctacggattctattaaacttaatattttggctatcttttcttggacttttcgtgactgtttcccgaaaaaatcctcaaagtatcctttatacgtagtaaccttccttactttttccattacgcaaaggtaatgtataaatgacacataagcaagcagaaagttcagtaattacaaatttttatgtatctttgttccgtgctctctaccgagagggcactttgtttttatcgcgtttagtcaaagctctgagaaaaagcggcaattttttccaagcaaagtaacgactaaacggactggttgtgttgtatccttactacacacaataaacgtgtccgtttaggtttataattgctttgctgggttgatgccgcttccctctctgagaattatattcactaatacgggcacgtcccggttttaaatctgctatatggaaaattacgacaaacaaaacttcttcgggctaccgcgtaaagtcgcttatttctttgtgatcagtacatggatcatcggtatatacgccattgtagaacaacaaaaaatcatccggcaatatcaaagtatagtagacgaaaccatacacaacaatcaaactcagattaaacccagccggacactactcaaacccgaaccgccgtttgactgtatgacgatcagcgaatacaactacatctttaacccggaaaatgacggaaaccgatagaggggtatttttcctcttttcatgcacaaagatagatcgcagccgttcatccatcaatgaccgctacgctatttcagcacaaaatatcctgcgcccctgcgtcgtgcggtattttctgtcgaaattcattgctggctgcccgtctgtgtccggatggatgtttaagaaaaaaggaaaaaaatgtgtaggggctgcgctggtgataccggaaattatgtgcacctttgtatgtttccagcagtgtaggccttgccggttacttggcggctgctgagagacgactatttaaaaactttagataaacggttctgctcccgtgcctgatactgtaatgggtcggcatatttttctttcttgccttggcattgaaagtttgatagtttaaacgggtcagcagagccgttctattttcgttaaatcaccctatactaatggcgctcagtaaacaatcctatcaataaaagtgtttcattgtacttttttcgtccgtttgctatggtatttcagaaataatcaccatctttgtaatgcgttatgtgatttttttgatgtagaataaagggactgcatttctttgttttacactaactgtaggtgtataattttatatgcctacagtttctggataaaaacggctctgcccccgggactaataccgtaatgggttagcatatgcttttccttgctctgcatcgaaattacataacgcaagcgggtcagcagggccgttcatttttccctgcccgatttacgtttgaactatgggcgaacaatctactatcaaaatcctgtatttccatcgacgcaaaaccaacgcaagcggttggtataagttggaatatatttttcagcgaggtaaaaagattctgcattatacactctctacccgggattatgaatatttagaaagtttctgttccccctgcattgccgagcgttcagaagtgattgtctatgtggccgaacttcttttggaaatccacaaagtgaaatattctcgcttgaaagtcaacccaagttatgcctatgctacttctaaatataaaccccgaatcaaccaaatgtgcaaaaagagccgttaccacagaacatctgtcattatagacgggctatagtactttgatttttcataataaattctcttttataattggccttgaatctaaattctgctcacctaaccagttagctcgccgaaccgctgtcactctatccccccggaggacagcggttctttttctttagtatacaagagcacgaataatttatcagacacattaccctttttaatttttgatgtatatttgttcgctacagatatgtgctgattcatggctgtatttgaagaaaaaacttgtgaaaaaatgaataaaattagtgcttgtgtgattctcttaatagtcgtgcttagctgtagcgatcctgtgaataacaggcagttaaagactacggaatctttgactcagaacattgcatccagtgacacgattaaagatgttcttaatgaaaatacagttaaagacttttctacggttgctttaggaatgaaatataggactaaaaaagaatggaatgactttaccgaacctgacagggaggaatacatcatcacttcaaaagggttaggaaagttgttcggaatacaggatagtgtatttgcagataatgatggaactatattgtcggaagaaaaccctgtggttttatgtgattatatatctgcaaataaatatgaatatcccaattagctaatcatttctacacagaataaatccgaagggcaatacacattgaccggagtaattcgaataaacgaggggactacttatagtgttcattgtaaattaaaagatgactactatgccggatgtgtatgtgtcgggaagtatcctattatgaacggtgattcaatcttatttaggatagaagaaatctatggcataacaaaaacagggaaagtggatatacttccattgaatacgccggtggaaaattgccccgaaccgtttgaacctactttcccggaaggaagaactcctgcatactattatgtacaaggagatgagaagcatactcaaagctggcaggaactgtaatctaaccaatcaaaacgaattgtttctttattttatcgcatatttaattgtttaattataagtggttaatcattcgtgtcggtatctttatccgggcccgggcacccgggctcataagcccaggtatacgggcttatggtcccgggtacacgggcccatgggcacacctgcctgggaccagatgtagattgcaccatttccggttgaacacgaagggaaaacaaaatgctttaagaggtgtgtttgcttaggaaatagatggtttgtgattgataatcaatggtctgtgcagcgttttcgccttaaaacagtaggtggaagatggaagatacaggtggaagataaaggactgaaaaacgcgatcttccacccggtcatttctttgattattagggaaataaactctaaaaggtggaagatggaagatcgaaatgcatttttcgtatgagaaggccttacattgatttatttcccggtgtttttcttttgctcatttctttctcttttttcttttttatctttgtagatagctacaatgatatctttcaaaatggggcagaggcaggtaagaattatgccacttgttatcgtcataaaaatgccattaaggagtggttgaatggctcttgctgtgtgggagatcgtaaatagtcctataatacataggaacattccataaataaaaaaagtcagggacaatatcagaccggcaatacagagcattactatgtcatactctctgaatactttcaatgtcagccattttttccatttttctcgtttggcctcctttctgcgttgcttttctctttccgggctgcattttttccattctttgaccatctccaaaaattcttcttggggacgttttaagctgatattatatctccgcatcttttcgctggtgcgtctctttttccttttattcatttgggtagtatgttgcgggtttaaagaaaaagcctgccaaaacaattgttttagcaggcttttttacaacattgaaagtttgtgcggatgataggactcgaacctacacgtcgcgagacaccagatcctaagtctggcgcggctaccaattacgccacatccgctcactaaatgctcactcgtttggagttttgcgctgcaaagatagatactttttccgattttacaaatttataagcaataaagttatttaccggggaatctgcgggcgatctctatcaatgtagcttttcctctcaggggctcttgtcaagagggttgtagaatagttccacatctttgtggagcagttctacaacccttcttttcatttttagcttttcttgaatatttaatactcttatttactgatgtttagactttattgatttcatcaatacttttgaggtacaattattggagtacaagtgcaaataggtatttgtagatttaaaatgattagccaatgagaagtttgaaaacagtgttgattatcttgttgtgtatgtgtggtatacatgtgcaagcacaacagttggaaataaaaggtttagtgacgtcatcggaggataaacagccgcttatcggagctacggttgccgtaaaaggggtaccgggaaggggagtggtaacggacatggacggccgttacactctgaaaatagaaccatcagataaaatccttgtcatatcctatataggaatgaaatcgtctgaggtcaaagtgccgaagaatggagtcttgaatgtggtgttgcagcccgaatcacttaatctggatgaagttgtggtgaccggatacggaaatttttcaaagtcatcctttaccggatcagctaacaccttacgggccgacatgctgaaaaacgtaccggtactttctgtagaacagaagttgcaaggtatgaccacgggggtaaatattacttccggttccggccagccaggagctaaccagagtatccgtatccgtggtatgggttcattcaatgcatccaatgaacctctttttgtgattgacggtataccggtcacttccggcagtatgggagccggtacgggggccgatgctgcctatatgaataatgccaaaacaaatgtgatgagtactcttaatcctgccgatatcgagaatattacagtgataaaggatgccgccgccgcttctctttacggttcgcgtgccgcgaacggggtgattctgatcactaccaagaaaggagcggcagggcggactaaagttactttgagcgcgagcggaggcttttctaatgcagctgtcaacttccgtcccacattgaacggtgaacaacgccgtgaaatgatttatgaaggtctttacaactctgcagtagacaagggactccaatctcccgaagcatatgcaaacgccaatattgatacatatgcggggataccggaactgggatatactgattggaggaaagaactgatccgaaccgctcataatcaaaactacgaggtgactgcttccggaggtaacgagcgaactactttttatgcttctctcggctttaaccgtcaggaaggtctggtcgagaattctaatctggaccgttactctgcccgcctgaacatgacacataaaatgggtagccgtgtcgaggtaggaggtaacatgatgtttacccagataagtcaggagatgaacgaggagcgcggttccaatatcaatcccttcctttgtgttgctgtgtctgccacaccttctatgcctgtgcgtgacgcttcgggcaactatgtggggtcttatataggcaccaatgtgaatccgcttcgtgacatccgtactgactataaccgcagtcgtatgacacgtatgttctccaccggttatgcttcggtagatattatcaaaggattgaaactgaaagagaccctgagctatgactatactgtacagaaagattcccgctatttgaatccgcttagcggggcaggtcccaagagcggaagtgatgctcagacctcaaagggatttaccgaatatggtaagctattgtcgtctacttcactcaactatacccatacatttgccgctaaacatcaccttgacattttggctgcctatgaattggaaagctatcagagtgataaagctatgggagagaaggctaaactcccctcggatgtgttgcttgagccggataatgccgctgtgctgaagagctttgtttcttctacacaggcatacagaatgatttcttacttgtcccgtttgaactatgattacgataatcgttattacattgcaggtagttatcgccgcgatggcagttcacgccttgctccggaaagccggtggggagacttctggtctgtttccggtatgtggcatctgagtagtgaaccttttatggaggctgtgaagccggtattgaacgatgtgaaaatccgtgcttcttatggtgtcaatgggaatcagccgggagctttttacggatatatggggttatacagttatgggcagaactatatgggggcagcaggttcatacgagtctgctcaagccaatcccaaactgaaatgggaaaagaactataatctgaatattgggcttagcctgacttttattgaccgtatctttgtgaatctcgaatactacaaccgcgatacaaaggacttgctttataatcgccctatcagttctactaccggtttcctgaactatcttgcaaacatcggtcagctcaacaacaaaggggtggagttcgaactgcgcacgattaactttgccggtcctgacttcaactggacatcggtgctgaatttaacacataaccgtaataaaatcgtggcactggacggagatataaagcaatctgtcgagggctcctggtttattcataaaataggtcttccttacaatagtttctacgtgaaagagtttgccggagtagacccgtcgaccgggaaagctctttattatctcaatacacaagatgaacaggggaattataatagagagatgactgacgatgcttctaaagcgcaagctattccgtataaatctgctgatcctaagatatcgggagggttcactaatatcatttcttataagtggtttgatctgggacttacctttacctattcgttgggaggatattcttttgacaaggcaggtactctgatagaaaccgacggcagcaaagaaaagtcatacaacctgcctgtatatgctttggaccgttggcagaagccgggagatagaactgatgtgcctcgttttgtattggaacagggagccggtccacaaaattcatcccgctatattcacagtaccgatcacatccgcctcaagaacctgacactcggtttcacacttcctggcagatgggtacaaaaggcactgatagagaatgcacgtgtctacttctcaggaagtaatctgctgacatgggccaaatggaaacagtatgatcctgaagtaccggttaatggtgaggtgttctgtgaggctcctcccatgcgtaccttcaattttggggttgagataactttctaaatcattcatcattattaatattcagatatatgaaacgtacacttatatacatgtttgccgctatgtcgcttttgggttcttcttgttccggcgactggctgaatttgaatccatctacctctgtgactactccgcaagccatccgtacacttgaggaagcacaaatagctttgaacggcatttatcgcattgccgcttcacatagttattatggtgataattatctctattatgccgattgccgtggtgaagatgttcaagcacgtgtcagcaagggagccggaaaacgtgtatcaccttattatgagttcaatgtcacggcagatgatgccttgaatattacccgtgtatggaatcagccttatagtgtcattcatcaggcaaatagtctgctggaaagaatagaatccggtgcggtggttaccgatgatgctgtggctctcaactgtatcaaagctgaagcgcttgctttgcgtggattggctttgttcgatctcacccgtctgtttgctatgccctataccttgaacaatggtacttctttgggagtacctattgagattaaaacaactttgcctactcaccagcctgcccgcaatacggtggccgaatgctatcagcaggtgatagacgatatgacaggtgcactgaaactctcggcactttccgctgataagaaaaacggttatcttaatgtgtggagtgtcaaagcattactttcacgggtatatctttatatgaatgataatgaaaaggctctcgccttggccaaggaagtgatgaataacggtggattgtatcagttgttcacacacgatgaatatcctactgtatggggaaaagacttcagttctgagtcactgtttgagttttactacactctttccgagcctgatggcggaacgggaggtgaaggcgctccgatggtttatgccgataatgtgaaggattggaacaaccttgtactgaccaaagcattcctcgatctgttgggagaagacccggatgatgtgcgtcattcattgaatcgtttgccggagaaaccggaagaggatatattgcccgaaggttccaaggggcatcctaaatatctgaataagtatccgggcaagacgggggataatccgcaggataatgacatctgtattatccgtctctccgaagtttacctgaatgctgccgaagctgcctttaagttagggggagcagaaaacctaaagttttctttggattgccttaatgccatcgtgagccgtgctaatccggcgaagtctgtaaaagagtcggagttgagcctggagcgtatcttgaaagaacgccgtaaggaattggtaggagagggacatgctttctttgatgccatgcgaaatggtttgtctgtaaatcgtaccggtggttggcatttgccttctgtagcggctgctgcggttattgctccgtctgatccgcgggtagcattacctattccgcaggcggagatagatgctaacccgaatatggtgcagaatccgcgttaatgctttctgggaggtgagatataccggcttttcggatgacagggctcgaaccggcatgttgtgagacaccagacagttattcactgaggaatctgcgggcgatctctatcaatgtatcttttcctctcatttcgtcttcttgcagcatatctaccttaatgtccggttcaatgccgaactcgatgtgcttcatctgtgcatcgaagtgagggctggcagagaaacgtacgctccacccgttgggcaattcggaagtaaagggcatacccgatcctcctccggttttatctccgatgatggtgacattgggcaggcaacgcatgtggttgacaaaatcgttggttgcgctgaaagaacggcgattggtcaacacgactgctttcttttgccagcgtaccccattggccggttccagatagatggcatagggtttagagaagtcgttgtgtccggttcctgtcttatggcagatgtatcctgtcagaaccttttcgttagtgaatcgggaagcgatgcgggcggaatttgtcgcgtttccaccaccattatcgcgcacatcgataattagtccattgcatatggccaggtaggagagcacttcgtccaagttaccgttgccaatcgggtcggcaaagctttcataccgtatatagccgatgttgtctttcagtatcttatatttgaggcctgctgccgtacgatagtccgtactggcacggcccagataagaatcttcaaccaggtctgcacggaagttacggggataatcctgataccaggcgtcgtaataagacacgttgtgagccgaagccagattgacatgcccgtcctgcaattcataaagcatttcactcagaacttcgaacagcccttcgttgctcatattcggggtaatacgtttttgatattgggtatagatatcatcccagtcgatttgtttgtaatcgagaaagcaatattgccggtcgatgattttccataactgctcaaagtttccttgtggatcgttggcatactcttcttcccggatacaggaagagaggagagccagaaagaaaatcaggcagaagctttgttgcaggatactatggataggaggattcttcatgattcacttctgttttaataggctctgacggcaggtggcaggggagttccgttcttatttcggatacggaacagatcgtgtacaaatcccaccatgaaaacttgtgaataagtatgtgtcttgattccgttcagtttggattgttggagatcacacaaatagctaaggcgcattttggtatatctgattggaaagtcgactgatatcatctgtcgtaacgccggctgattatgcagagaagtaaaacggactacgccactggcgtgtccgagtgtgaatatttcgtagtaagattgcccgtaatggggagagaacatgagccctattaccggaagattaacctggtaacgtaatgccaacggataattttttatttttgtatgccagatggccattcccgaagcgtccaggttgatgtaagcacgtgctgaggccggattgttggtattgcgcagattgtagacaaagccgccgttgaaatctcccattcctccggcaagcagcttaaagttgtctgttatgcggaactgatagtgcagtccatagttccaattcactaatccggcaaatgtattgttgttatctacccggttgtgagtatatgccaggtttgcctggaaaaagttctgtaccgagacattgccatcgccccaggcggtcatacgcattgtttcgcgtgagatacgaaattcgatacctttatattcctgcggagaaagataggtgtcgaatacattggtgtatcccacaccgtacatggtggcacgtgtcacatagcgggtagcttgaagtgagtctgtgccgttaccatttccgttccctccaaaagaagggagagcgattgctatcattaataatagcaatatacttgtatttactttcatacgcagttttatcttggacttgtgctaaaacagcttcatctgtccggtcatttcatcgagtatgtcgttttctgttttaccattgtccgggtccagattttccggttcttcatccgtgttttcatcatccgtggtttgtggcggatccgggaaacgggtcggttccagttcgttgatggtctctactgtataagtagtgagacgtttccctttggccttaaaacctttgacggcaatgaattcttcggcatcaatgacaacaggttcgcggaaattgtcgtgacctccgaagatgatctccaatcttgggtaatactcatccgtcagtaaaatcaggcggttatgtttgttctcacccagatagttctgcttgcgggcagtggcttcgaagcagaaacgtttcaggtacggatagttctgttggtcggcatcataaagcgcagccgtccatatcttgttggcatcgaacttctcgacgatactcacattatcttcgtagtgattgctgagatcgaagtttgaggtatagaactctccggtgttcagcacaacaaggatgctgtcgtcgctctggaactcacccaaatattcaccccggccgtcgtaattgaggcggagcacatcgcggtcgaaccatactttacgtccgcccagtgtagagcctccccgttgtttcaatacaattttgtgtaccggcagacgtgtcagaatgacgccctgactttgtcggctgcgaatggtcacttcactgaaatcacgctcgaagatgatgcggcgtacacgtggattaggtttcaaggtgaccttgatgatttcagcttcaccattggggttggcactgaaataagaaatgcgtgaatcgggtttaccttgtgtcacgtcgtattcacggtcgcgtacgatggaagtgactgcaaaccgtttgatataatgtgttccctctgcgccgtcgcggtaggctacgttgtagatggtgcgtttgtcattcttcttaaatacattgacgtagattacgtttttgcccacaaactttttgtcggctacgggagtgaccatgtaacgcccgtcccggtagaagatgatcacatcatcgatgtccgaacagcatgccacgaattcgtctttctttaatgacgttccgatgaagccttcttcacggttgatatagagcttttcgttggcttccaccactttggcggcttcaatggtgtcgaagttgcgcaactcagtacgtcgggggaagtttttcccatatttatctttaagcatccggtaccattggatggtgtactccacgatgttggccagatgattgttgatctcggcaatgtcttcgtttatgcgggcaatagcctcttccgccttgtcggaattgaacttcaggatacgtcccatcttgatttccatcaggcggaggatgtcttctttcgtcacttcacgtatgaattgcgaatagaaaggagtcaaccgttcgtcgatgtgtgcgcaggcggcatccatatctttagactgttcgaactctttatctttataaatgcgctcttcaatgaatatcttttcaagagaagcgaaatgcaggctttcctgtagttcgtctttcttgatttccagttcctggcgaagcagggacaatgtattgtcggcagattttctcaggacgtggctgatggtgaggaagtgaggcttctgatcatcaatcacacaacagttgggcgagatgcttacttcgcaatccgtaaaagcatagagggcatcgattgttttgtccgatgaagtgcccggagccagatggacaaggatctctacgttggctgctgtgttgtcgtctaccttgcgtatctttatttttcctttgtcgacggctttcaggatggagtcgatgaccgaagtcgtagtcctgccataaggaatttcggtaatggcgagtgttttattgtctactttattgattttagaccgtatctttactgctccaccgcgttcaccgtcgttgtatttcgacacgtcaatagaacctccggtctggaagtcgggatatagtttgaactcttcgtttcgcaggtaactgatggaagcgtcgcaaagttcgttgaagttatgtggtaagatcttggatgaaagtcctacggcgataccttccactccttgtgccagcaaaagtgggaacttcaccggcaaggtgataggttctttgtttcgtccgtcatacgacagtttccattcggttgttttagggttgaacactacatcgagtgcaaactttgacaggcgtgcttcgatataacggggagcggccgcaccgtcaccggtgaggatattaccccagttaccctggcagtcgaccaataagtctttctgtcccaactgtaccaatgcgtcaccaatagatgcatcgccatgggggtgaaactgcatcgtatgtcctacaatgttagccaccttgttataccgtccatcatccatgcgtttcatggagtgcaggatgcggcgttgcaccggtttcagtccgtcattgatatggggcacggctcgctcgaggataacgtatgaagcatagtccagaaaccagttctggtacattcctgtaagttgatgtttaatgctttcgttatgtgagtccgccggcttatagtcagaatgtccttccgtaatctcgttgttctcttcgctcataaaatcaaatttccctctggttttaacaacaaattatcttttttacatcattattgggtgatgtgcaggcaaaaatacgaatttaattgaaaaaaatcatttactttgcagattatttctgagtctggcttacaggcagatgtatgaaatgtaaattgtaaatgactaaattgaaaataagacgatggcacaagaagatgtttttaagaagttagtatcacattgcaaagaatacggttttgtgttcccctcaagcgatatctacgacggattgggcgcagtgtatgactacggacagatgggtgttgaactgaaaaacaatattaaaaaatactggtgggacagcatggtgctgctgcacgaaaacattgtcggcattgactctgcaatttttatgcatcctaccatctggaaggcttccggacatgtggatgcattcaatgatccgttgattgacaacaaagactctaaaaaacgctatcgtgccgatgtactgatcgaggatcaactggctaagtacgacgataaaattaataaggaagtagccaaggctgccaagagatttggcgaagctttcgacgaagcccaattccgcagcaccaatggccgtgttcttgaacatcaggcaaagcgtgatgcattgcacgaacgttttgcaaaagcactgaatgacaacaatctggaagaacttcgccagatcattattgacgaagaaatagcatgtcctatttccggaaccaagaactggacggaagtccgccagtttaatctgatgttttctaccgatatggggtctactgccgatggagccatgaaaatttatcttcgtccggaaactgcgcaaggtattttcgtaaactacctgaatgtacagaagaccggtcgtatgaaagttccttttggtatcgctcagatcggtaaagctttccgtaacgaaattgtagcccgtcagtttatcttccgcatgcgtgagttcgaacagatggagatgcagttcttcgttcgtccgggcagcgaattggaatatttcaagaaatggaaagaaattcgtttgaagtggcacaaggcacttggttttggcgatgatcattatcgtttccacgatcacgataaattggctcactacgcgaatgccgccaccgatattgagttcctgatgccattcggtttcaaagaagtagaaggtattcactctcgtactaatttcgatctttcccagcacgagaagttctccggaaagagcattaaatattttgatcccgagttgaatgaatcgtacactccgtacgtaatcgaaacttcgatcggtgtcgaccgtatgttcctcagcattatgtctgccgcttattgtgaagaacagctggagaacggtgaaagtcgtatcgtattgaaattgcctgctgcattggcacccgtgaagttggctgtaatgccattggtaaagaaagacggactgcctgaaaaggctcgtgagatcattgacaatcttaagttccacttccattgtcagtatgatgaaaaagacagtatcggtaaacgctaccgtcgtcaggacgccatcggtactccgtactgtgtgactgttgaccatcagacattggaagacaattgtgtgacactgcgtaaccgcgacactatggagcaggaacgtgtggcaatctctgaattgaataatatcattgccgaccgggtaagtattacctcgttgttgaaaacaatccaataactctttagcgaatgaacaaaaaaatctatttattaccgttgctgttactggcccttatctttgtttcttgtgaagagacgaaagaagctacaaagtttgataattggagggcacgtaatgaaggatatattgattctttgaaggcggtatttgatgacaagaaggatcccgagctgaaagcttttgcaccggaaataaatcctaagttgcgaatttactataaagataaaacacctgctgatagacaattgggcgataaacctctttatacggattctgtcgaagtattctatcgtggttattatatttttggggaatcttttgatggtaattttactggtagtcagccgaatcttgactttgatgtacctttgaagtgttatgtagatccatttaagagtactacacaaacttcaaagtatatatctgttattagtggttggggagagactctacaacggatgcgtgtaggacaacactggactatatatttgccttatgaaatggggtatggtgaaaaaggggatagagatattccaggatattcgactttgattttcgatatacaattacaaaaaattgtaaatgaataggatatgattaatctctcctgattattaatgcaataatcaggagaggttattttagggtttgttttatgatattcttactgtgtggcagactttttattgaggttgccattctactaatgggtaactccatccattatacattttagtgcttggtattccgactacttcatgaataatataaccttctatatttatggagtgcgattgggaggttgtgttttgaacgtctatgcggatctcttgattgagttttacttttcctaagttacgtttacacacattgaagtttatggagatgttcctttcttctttttctgcaactttccatttcttcttacctttccattctaactttaaaaccaagaaaagattactccatgtggtatggggtgggaggttttcgcgaataatgaccgatttaagttcatggacatatttgtatctgaatttggatcctggtattttaaattcatgttgatatgatgtcccaatctttccatattgtgttttgtatatcgctcttgttgttatttctgattcttcttggttaactcctacttgcccatataaaagtgggacagtcaatgtctttcctttaattgatttcacgtacatatttcctttttcaaatgcaattatggtatcatttatttgcatttccattttatggttgaatagtgcttgaaatgctctcggcatttctgccatgatttcatcttcgcaaaattcaaggtctgtatatagcggatatttaatacccgaggcacgaacccattctgtttgttcttcataagtcatgtaagatagtgtgtcaagggtgttataaaactcttttgcactattgaatacaattctggaatcttcttctttttgcggatttacttgattagtcaccgtttgatccaattctgtttcatcacatgatgaaagtagaataattgaaaatagcaaaaataatttagatatggttttcatatataataaagatttatactctttgagagaaagatcttgttattatttaaaaataaaatctcagatttcatttgttgtaaattctccggtatatgctctgttatccagtattaattcaatattatagtttgattcactttgattgttgcctaaatctatagagatactacaatcgtttgttgaaacattgtaatgaatggcttctcccgtatctaaattcataattgtgacaactgcagttttatttatttctctgaaaataagatcaaccgtatttccacagataaaagcttctgcgggacaaggtgggggcagagaacgttgatggtgctgagtttctactttcattttaattttctttcttgaggccattgtttctgcatttatatagccaacactaatgcataagaatagggtaattagacaggttaactttttcatgataaatgaatttatgtttctgcaaagatagtctaatgcccaagtgatgatactgatgtgagataacaattgaaggatttatgatcgctgataatcagtggtttatgaattttgatataacaaggaggcggaaccgtatgataaaaggtcataaaattccttctgaaggagagttctcattaaaaattatagaaaaagtctggggactgatttgtttttttatgcgatactttctttgggtgagtgcctggttactttcaactctcatacaaaatttgattgtagaggtagatagacgcaaatattgtagaatgcaatagaagaggtcttcttgtgttagttttggatattgttctcgtaaatcctgaattgcttcgatgaaaacttcgtttatctctttctgtatggaattaatttctttctgtttttcttctttttcttttttaaatttggctgtttctattgcatgtaattttttatatgatgtggaagtatgaaacagtcgtgtacatatttgaagtgttcttctccataattcaacttgttgctgctttagttcttcttttttcaattctttattcctttccgcaatatatgtattactatcaatcagcgttttgattttctcttttaattcatctttctctatttggttatttcttaattcacattgtattttaatgtatactttttttcttttattatctttataaagaaagataaatgtgatacacgcaatgagtaataatgtagttacaataagaaaagctgcatgcttttgccgttttataacttcggcctgttgtaatgtctctgtcgcatgttgctttagtatgtgacttatttctgcactatggtttaaatcttgtatagaatcatatagaatgagagacgtgtcattgtatagaattgcatcatttaattctccttgttctttttttatttcatatagagcttggtatgccgatgcctgtgtatttaagtctgaactttttttagctaaattgatatagtaaaaagcagaatccaattgattcagattgtgtaatatttctcctttccaaaaatacatggcagatagatcgctactgcgtggagcatattgaatagagcgtactatataactatatgccgcttcatagaggttttcattgtcataaatccgggaaatatcacaaaataagatagactgccatgtagagtcattggtacttgatgcaatggtgagagctgtttggtaatatttaagagctttctcaaactgttcttgaatagcatatatgcttgccattcctcgaagtggatataggatattcttgctattgtattgtttataaatgtagtatgcgtctttatatacttctaaagctttatcataaaaatcttggtttttatagcatgtacccaaattatcgtatatcaaagttaataatgtgtcatggtctgatgttgctttttctgcaatgagatatgagttaatggcttttgcataatcattattgttttgataaaagcgtcctaaataaaagtatgcttttgctttattgttgtcttttgataagtgatcataatggtttatagcaatcaaaattaatgaatcgttgattaattgatagccggttttatcctgtgcttgtgctaataataatgcgtattttgcgttttctgaaacagataaatctgtttgatttattgtttttaataatttaaacgcactatcgggttgatattccataatggaatctgccagaaagatggttctgtttatttgttgatgctgtgaacaagaataaatgatagtgaatcctaaaaataacagtattatatttagtaaatattgtctcatctttatatttttgcttattcggaaggtaaaggtaacaaattttgtaaaaataataattgatattactttttaaattttgatagaatggaatatatcaacgatttaatccgacggaaggaccgccttttatcggaagacgaagcaatgagtttacttgaaaatggagaatacggagtgttatctatttcttcacctgaagcaggtgtttatggcattcccattaattatgtatgggataaacaacagtctatctattttcattgtgctcccgaagggcgtaagctttgtatacttcaagactgtaatcaggcatcgttttgcgtggtaggacgcacgcgcgttgtttccaatcaatttagtaccgagtatgaaagtatcgtgattaatgggactatgatttgtcagttagaagaaactgagaagcgaaaggcattggaacttttgcttgataaatattctccggaagataaaaaggtggggttgaagtatatggaaaagtcttttcaccgtacccacgtcttgaaacttgttattaaaacaatatccggtaagtgtaagaaaatgaatcagccctgtccagattattaagaagcccctgccttatctctcccttgtttatcttttgtttttttagcatgggttatttttctttcgcaaatgtaatctggattacattctttttaaatggaaatccctttctttgcataaatacatagcatacatactatgaaggtaaaagaatatatccaatggttactcccttcgcgtaagtggagagtacttgcgatcattataacaggtgtgattgtaggtggaggggctctgaccctttatatgcttcgggcacatacctatctgaccgatgatccggctgcttgtgttaattgccatatcatgggaccgtattatgcgacgtggtttcatagttcgcatagcaggaatgctacatgcaatgactgtcatgttccacacgaaaatgcagtgaagaaatgggtattcaagggaatggacggtatgcgtcatgttgccgtattcctcacccatggagaaaaagatgtggttcgtgccaatggtgaaagctcggaggtgattatgaataattgtattcgttgtcatacacaactgaacactgaatttgtaaatacaggacggatagattatatgatgtctcaggtaggtgaagggaaagcttgttgggactgtcatcgggacgtaccgcatggaggaagtaacagtgtcgcatccactcctaatgcgttagtcccttatccggattctcctacaccggaatggttgaaaaaaatgatcgaataatatagaaaatcaagataacagaattatggaaaagaaactgaaatcatggcaaggatggttgttgttctgcggagcgatggtggtcgtttttgtgcttgggcttgttgtctcggcgctgatggaacgccgggcagagacggtaagcgttttcaataacaaacgggtggaaattaccggaatagaaccacgaaacgaagtgtttggggataactacccacgtgagtatgaaacatggaaagaaacggctaagaccgatttcaagagtgaatttaacggtaacgaagcggtagatgtacttgcacaacgtcccgagatggtggtgctttgggccggctatgcattctcaaaagattattcgactccgaggggacatatgcatgctattgaggacattacacattcactccgtaccggtgcgccgatggatgataaaagcgggccgcaaccttctacctgctggacttgtaagagtccggacgttcctcgcatgatggaagctattggagtggattcgttctataataataagtggggagctttcggtagtgagatcgtcaatccgataggttgcgccgattgtcatgaaccgacaaatatgaaattgcatatcagccgtccggctttacgggaggcttttgcccgccagggaaaagatatagacaaagcgactccacaggagatgcgttcgctggtatgtgcgcaatgtcatgtagaatattatttcaagggagatggcaaatacctgactttcccttgggataaaggattttcggtagaagatatggaagcctactatgacgaggccgactttgccgattatacacatgcactgagcaaagcccgtatactgaaagcacaacatccggattacgagatttctcagatgggaattcatgcccaacgcggagtgtcgtgcgccgattgtcatatgccctacaaaagcgagggaggcatgaaattcagcgatcaccacattcagagtccgttagctatgatcgaccggacttgtcaggtttgtcatcgtgagagcgaagagacattgcggaataatgtatatgaccgtcagcgtaaagcgaatgaaattcgtggccgtctggaacaggagttggctaaagcgcatattgaagctaaattcgcctgggataaaggtgcgacggatactcagatggcagaggcgttgaagttgattcgccaggcccagtggagatgggatttcggtgtggcttcacacggtggtgcgttccatgctccgcaagagatacagcgcattctgggacacggacttgataaagttttgcaggcccgtcttgccatctcaaaagtgttggctcagcatggctatacagccgatgtgccgatgcctgatatttcgactaaagagaaagcgcagcagtatatcggtctcgatatgcagaaagagcgtgaagcgaaagataaattcctgaaaacagtagtacccgaatggttggagaaagcgaaggctaacggtcgtctggctaaactgtaaactatgtggcagaaaccttggggatataaagaagggttcgccatctgtggcggactttttctgacaggcattttcctgcaaatgacgttggggaagtgcacgctttccattctttcttaccctgtgaatgtgtgtgtagggttgctatatgtcgttatcttgttatcggcctacaccttttcacaaaagagttattttatccggtggatggggagctgtcaggctgccgtttcatccatggtgtcagtggctgtgctcactgtagtgatgggactgatccgccaggtgaagtccgatatacctttgtccggtattgaaaactggctgggattttcccaaatgttgtccgcctgttcgtttgtgctgttgttcctctggatggtcactttgttggggttgaccaccattcggcggattcatcatttccattggcgggacgttccttttgtgctgaaccatctgggacttttccttgcactgaccggagctgtattgggaaatgccgatatggagcgtctgcatatgactacaaagataggacaagccgaatggcgggcttccgatgaaaatcagaaaatgcgggagctgcctttggctatcgagcttcagaactttacgatcgatgaatatcccccgaaattgatgttgattgacaatgaaacaggtaaagcactgccggtcgggaagccggaaaacctgctgattgaagatgattttcatgtcgggcatttgctcgattgggaaattcacatagagaagaaactccctttggcagccagtgtagcgactcaggatactttgaactttgtggactttccttcaatgggagctgcttatgctgtctatctgacggcagtgaatgataaaacaggccggaaacatgaaggatgggtgagttgtggcagttttatgtttccttataaggctatccgtcttgacgatcagaccagtttggtaatgcccgagcgtgaacctcgccgttttgcatccgaggtgaaagtttatacagagtcgggacgccgtgattcggccacgattgaggtaaataaaccttttgagttggagggatggaaaatatatcagttaagttatgacgagtcgaaaggtcgctggagcgatataagcgtgtttgaactggttcgtgatccgtggttaccggtggtttataccggtatctggatgatgatagccggagctgtctgcctgttcgccctgtcacagaaaagaaaggaggacaacgtatgagttgggatcattttgtgatatttgccatggcagctcttctgtgttgggctatcggtgccgttgccgtatggaaagagaaacgccagtttgttgtttatgcagccacgttggcaggactggccgtcttttttgcttttatccttgggatgtggatttcattggaacggcctccgatgcgtacaatgggtgaaacccgattgtggtattctttctttttacctttggcgggcatcatcacttatagccgctggcgatataagtggattctgagtttcagctttgttctttcgcttgtattcatctgtatcaacctgtttaaacccgagatacataataaaaccttgatgcctgctttgcaaagtccttggtttgcaccgcatgtcattgtatatatgtttgcttatgctatgttgggcgcagcggccgttatggcggtatacctgctttggatcaagaaaaaagctaccgaagaacgtgagatggaactgtgtgataatttggtcaatgtaggactatccttcatgacattgggaatgttgttcggagctttgtgggctaaagaggcctgggggcattactggagttgggatccgaaggaaacctgggcggcagccacgtggataggctatctctgttatatccactaccggatgaacaggcggcaaaaagtacgtgtggcacttgtcgggctcctcatttgttttgtattgctgcaaatgtgttggtatggcattaattatctgccatcggcacagggaaccagcgtacatacgtataatttgaattgataaatcgctaactactaattactaattgagttatgagaatcacgaatctaatctgggcagcaatgctttttgcaccgctgtccgcctttgcacagcaacaaaaggagaatcagtttacaattgatgcacaaatacgtactcgtggtgaataccgcaatggagtgttgaacccccgtcccgaaggcgcaagtccgactttctttatcaacgagcgggcacggctatccttaggttatcagcgcgatcgcctgcaaatgaaacttgctgcacagcatgtaggggtgtgggggcaggatccgcagatcgataaaaacggacggtttattttgcacgaagcttgggcacggcttgatttttcaaaaggcctgtttgcgcagttggggcgtcagccactctcgtatgatgatgagcgtctgcttggcggactggactggaatgtggcaggccgcttccacgatgcattgaagttggggtatgaaagcaagatgcacaagttgcatttgatactggcttttaatcagaataatgaagatcgctcctatggtggcacttattatgctcccggtggacagccttataaaaccatgcaaacggtatggtataatggccggtgggctaaagatttcactgcttcactgctttttatgaataccggatttgaaacagggacggaagaaaagggtaaaactgctaatatgcagacgatgggtacttatctggtgtatacacccggggcatggttgctgaatggtagcgtctattaccagtcgggtaaaaacaaagccggcaagaaggtatctgcttatatgttcagcttgaaagccgggtataagattgatccaaagtggagtgtaagcctcggcacggactacctgagcggagaccccgacagtaagaaggtaactacttttgatccgctttacgggacacatcataaattctatggaggaatggattatttttatgcatcggcttataacaaaggtttgtgggacaaaatactcagtgttgatttcaagccgacccaaaagatagggctttcactgaattatcaccatttttctacgacttatgacgtaacggccacagacggtaaagaaggacgcagtctgggatcggagttcgatttgcaggtagattatgttttgatgaaagatgtaaaactgacagccggttattcgaccatgcttggaactaaatatatggacattgtaaaaggtggcagccataagagctggcaggactggggatggctgacactgaacatcaatccgcgtattttatttaccaagtggtaggattggtacgggagaaaatgctatctttgctaaaaagacaagcattgtggtaaaagtagagtttacagacgaatatcaaaaaatcttgtggcagatatctttatttaaggatatggatgtcagtttgcaacgtcggctgcctttggaactggaactttcggtgtacgaggttgccaggaaagaggtcgtattgaagcaggacacctattgcaatcatttgtatgtattgctgaagggagaactggaggtcaatatcgttgatgtggcaggaaatctggtgaaggtagaagatatccgtgctccccgtgcttttgccacaccccatctgtttggcgataagaatctcttgcctgctacgtttactgccagcgaagattctgttttgctgatggctacccgtacttccgtttttaagttgatcagttccgtacccgatttactgcaccgtttcctgtgtgtcacaggcaattgtaacaagtgtacggtcacccgtctgaggattctttcttacaagatgctgcgcagccgtttggtttattacttcatggagcataagacttctccgaatacggctatattggagcataatcaggtccagttggcagaatatctgggggtaacccgccctgcactttcgaaagaaataaataagatgatgaaggagggcctgatttcaatcaataaaaaagtggtgacactggaagatatggtggcacttaaagaatatatttgaaagggctgtgccaagagtcttttcaccacagatcacacagattatcaatattgataatcaatggcttaaaatttactctgtgccttctgtggtgagtttcgacacacccttctcaatgctttgctccaaatcttgtagccttcctccgtcagatggagcccgtccgtagtcagttctttccgcatcacattgctacctttctccgtaaatagagggaaaaggttgataaaaggtattttcctgtctttggcaagtgcttccaacttactgttgatttcgggtatcaggtcggttttaccggtcattgttttgtatcgtccgaacgattcgttaatgggtaaaaggctctgcagatagagttcggtggatggtgatccggttcgtattttgtctatgaccagagtaatcagttctaccacactatcggcactcaggttgtgtgacacatcgtttattcctgccatcaggaaaatcttccggggagtgccgggcaatatctggaaaagacgttggtaaattcccattgcttcgtcaccaatgattccgcggtttcttatattctttttattcaggcgtatgctccagtctccgccgttttcggtgaggctattgcccaccattacgatatccttcggtccgatgggagcatctgcttcaaattccaggaaacgtttgtaataatgatccgtatatacttgtgcgggcgggcagatagaagcggctactgcattggcaaccagcgaacggaggcggactacactgtgtccgtcttcaggatgcacggcgttgatgagcaggatgacggccgtgtcgttatctgggtcaatcaggatggaagtacccgtatatcctgtatgcccgaaggtgttcggcccgaagagatcgccatgatttgaggcataagctgagaagacatcccatcccggagtgcgtcccagtccggctacttcgcggggaacggtacgcatggtttttacccccagtgggctgagaatacggcgaccattatattcgcccccattcagcaaggcagctgcgagaacggcaatatcattggcgtccgagaagacccctgcattgccggagattcctccgttcaggatgcgcgccaacggatcgtgtacctgtccgcagagtacacttccgtctttttgcttctcggtaggtgcaatcaaatccatccaggggtaatctacggtatttatccactttccgtctttctgctgtacggtgggcagataatcggtgtgctgcatgcccaggacattgaagatattctctttggcaaagtcccgcaggttttgtccggtaatgacttcgatgacatgttgcaaggtgatatagttgaggcaactatactgaaaattcgtttgaggcttgaagtcacgtttgcaagtggaaatatacttcatgagcccttccggattgggtgaaccgtactctttctgtaactcggctaccggtgcgtaaggtggaaggcccgaagtgtgagtcataaggtctacaatgcggatgtcctgtttctctccgttctctccctgccattcccggaagtcaggcaggtagaggttgacgcgatcgagtaggcgcagttgtccgcgttcaatcagaatcatggcagaaacagcagtcgacatcggcttgctgcaagaagccatatcgaagacggtatttatctccatcggttctatattgggatagatccgccggttaccataagccttgagataggccattttgccatgacggactacggcgagtacggctcccggtatttctttgttaaggatcgccttctgaatagcctcgtcggcatgcaacagacggtgagaatccatgcctacttgctcgggggcaacgcgtggcagaggttgtgcgacagcttgcaggctgcagaacagaaacgccaaagcggtgagcagagatttcgtcccttttctctcctgcagagagatgggggagaagtgaactttgtttttcgtattcatggtattgtaagtttaggagggttcggttttgttatccggctttatatgcatccaccgcttttttcacggaaccgtgcatcagcaacagtgctttagccttgtcatattctaacccgagttcttcgacaatcatgcgtgtgccgcggtccaccaacttctggttgctaagctgcatattgaccatcttgttgcctttcacgcgtcccagttgaatcataaccgaggttgtgatcatgttcagaatcatcttctgtcctgttcctgatttcatgcgcgaactgcctgttacatattcggggcctacaatcatttcgataggtacatcggcttctgcggccatcggcgagttcgggttgctggtgatgcaaccggtgaggatgccgtgctcgcgtgccacatgcatggctccgatcacatagggagtcgtacctgaggctgcaataccgatgacggtatctttactgttgatgttatgttccgtcagttcttcccacccccgggtggtattgtcttcggcattttccaccggattacgcaaggcggtatctccgcctgcaatcagtccgatgatcaatgtgggaggcatcccgaaagtgggagggatctctgaagcgtcgagaaccccgaggcgtccgctggttccggcccccatgtagaagatgcgtcccccctgtttcatgcgggggacaatctgtgtgactaacttttcaatttgaggaatagctttctgtacggcaagagccaccttttggtcttcggtattgatatcttccagtatttcgcggaccgacttcttctcaagatcactgtagagcgagggttgctcggaaatcttgacgaaggatgttttatctgatttttctatattactattcatgtttttgttctataattcgtatacgttactcgtgaaatttaatcagtccttccatcggactcttgataatcgttcccaggtgaatccccattgccttacacgcctccgatagtaattctttgtagtagaacgctactgaaccgatgaaatggacccgggcatgctggtagtcgtattgcattacattgcgtttcaggaactttttaaagctgttcagaaccagttcgcgtatggccggttcatcgaggtgttcgaccaggaatggagagaaacttgccaggaaacgatttggaaacggttggcgatatacccggtcgataatttcggcaggcgtcaggttgtattgttccaggaacttttctttaagtcccggagtcatttgattcttaaggatatcgcctaccagcagcttacccaaaaccgctccactgccttcgtcacccagaataaatcctaatggcgatacattgctgactatgtttttaccgtcataataacaagagttcgatcctgtgcccatgatgcaggcgatgcccggttgatggccacacagtcccctggcggcagcaagcatgtccgtactgatctcaatctctccgcttacttgcagatgcgcagctatggctttgcgcaccgtttctattttgtcggggaaagcgcaaccggctccatagaagtgaacagtctcgaacttgtttgtctttaattgaggaatcagggcggttgctatttcattactgatttccttttcagactgaaagaaagggttagtgcctttcgtaaaaatctgctggactaactgtccatgctctactacacaccaatcggtcttagtagaaccactgtctgctattagtatcatatctttatatatatttttttcttatacaggatgtatccgatacaccagttcaaccctacgaataagatggcgaatgctaaagaaccgggataatcgccgagcaggggttggaggatgatcttatacacaaatccgtgaaggctgatggtatgaccgtcataaggtatcagtatgttgcccaacagaatagagagaacggctccggtcacatagatgaatagtgggttgactccgaacgattcgaagaaccggctccatcgtgtataacctttcacgtcgataatccatacgaggagtgccaggaaactggatgccagtccgcaagtgacaatcgcgaatgtcggtgaccagatcttcttgctgattggacagccgtagctgagcaggaaacccgcaaaggtgaggatagtgccaaccaggaacaggcgttctattttttcattgatgtcttttacttccatcagcagtttgcctacgcagaagcctatcagcacatgggctatcgaaggtatggtgcttaatacaccttccggatcgataccgttgtctttgtacatatgtgcctcgcccaatacggcacggtccaccaccgccaggatgttggtactgttgtattcaaatccgtttccggtgatcaggatgatgaagtaaccgattagcaaggcggctatcaggtatgggatgtatttatgcttcatgattaaagcgatgatagccgttgcgccgtagcagagggccaatcgctgcatgacacccaggatgcgaatgtgaccgaaagtccagactgattcccccagacgggagaagaatggaatatcttcgccggatagtgaattccaagtgtggcaaaacatggagaaccatgcgattcccaaaccgatggcaaagatcacaatggttcttttaagtattttcaaggctgcagaatgactgaattcgaagttatactttcttaatgatatataggtggaaatgcccatgatgaacatgaagaaaggaaagaccaggtcggtcggagtcaggccgatccatgccgcatgaccgaggggagcatatacgtagctccagctgccgggattgttgaccataatcattcctgcgatagtgataccccgcaacacatcgagggcaagtagacgtttgttggctgtttgattcattgcattcttatttaagtgttaagttattcttttgtttcacgtggacgagtgcactgatccaccagataggcaatcgatacataggggatgccggtgttagtggctaaaccgatttcacaggtgcgactgtttgaatagccgatactgattcctgctttctccagttgcggacgtagtttgcgtaaagcataagtgttgagttccggccgggtgaatcctttatctccggcaaagccgcaacaacccacctcttccggaacaagcacttgcgttgaacatagtccggccagtgaaatcagtgtattcgacaatcccattttacgcatggaacatgtgatgtgtacggctacgggacggtctgtgggagtgaattccagtttatcccgcaggaacgtatagataaattcagccggttcgtatagcttcatcttttggatagtggcacgcatacggtgcagacaagggctctggtcgcaaagtaccggataacgtccctgttcgctggcctcccataaggcggcttccagttcagccgatttgctgtcggctatatccagcatacctttgctttcccaaatggttccgcaacagagtttctccatcttgggcgggaagatgacttcgtatcccgctttctgaagcagagagagcattttgttaaccaaaggttgctctacgggagaattttttgccaatcccatagtttggttgatgcaactggggaagtagaccaccttgttctttgcatccggtgccttgttgttgtccttcttgtgtatcttatagctcataggcatggccggtgtccattgcggaagtccccatacgttgtgcatctttcgagtaatggaagtcatcctggaagttcccagcaggctgtgtgtcgtattggcaagtgacagtaccggtcgcagggcattttttattcctgcgaaatgattggcggcaaattttcccgccttataaccggtgctgttggacggtagctctgcctgacgcaggaggtgggtcaggtcaccggtattgatacccatcggacaagacgtggcacacaggccgtcaccggcacaggtctgattacccggataccggtataacttggacagtgtttccagtaactgcggattttccccgctttttttcaggcgtgagatttccctctgtatgacaatgcgctggcgtgaggagagcgtgaatccgcacgagagacagttcacttcgcagaatccgcattcgatacaccggtctatctggcgtgtcacttcggagccttctcctattgccaatggtgagagaggcttgaaatgtttgatatggcattgagggtcgtcgttgaagataacacccggattaaataatcctttggggtcaaagagttgttttaccgccttcatgatagcgaaagcttcttctccccattcctgctttacgaatggagccatgtttcgtcctgtgccgtgttctgcctttaatgagccgtcatatttgtccactaccagttcttttatgtcgttcatcagggcttcataccgttttatttcaacttcattactgaatgactggttgataatgaagtggtaattgccttctaacgcatgaccgtaaatgcaggcgtcatcgtatccgtgccgggcaatgagctgttgcagttcggctgtcgcctcggggaggtcttcaatgtggaaggccacatcctcaatcagacaggttgttcccggaggacgggttcctcctacagaggggaaaatgcccgaacggattgcccaatatttggaatattcctcgggacggtcggtaaagtggaccgggatgtaggttttaaatgcctttaatgtatcttcgatgacagtgatgttgtggttgagctcttcctgtgtgcgtgctttggtttcggtcaatacggctgttagcccttctcccgtcggatcattcacagaagccagggatttccagtcgagcagttccgcaccttttacaatccactccccatctgtgttgacgagttttttcatggctaccactgcacggcatgcttctttgatgtcgctgaaatagagcatggcgcttgccttgtgcggatagtcgtattccgttttcatagtcacaccggaaaggaaagctaatgtgccctccgagcctaccatcaggtgggcaataatatcgaacggatcatcgtatacgaggaagggaagaatattcaaccctgttacgttcttgattgaatatttataacggatacgtgcactcaattctttgttgctgcgtacctggtcacgtagctcgcagatgcggcggaggaaatcgggatgatcttcttcaaagttttctcgagattcctgactgccggtattaagataaaatccgtcagggagtatgatacgtaccgacagcagcatcttatcactgttggcatgtgtcccgcagttcatgcccgaagcattgttcattacgattccacctaccatggcgctttttatggaagccggatcgggagcaaatttacgtccgtaaggtgcgaggatctcgtttacccgttgtccgatgataccgggctccaggtaaatctgttcgtgatcgggtgagagttcgtagtgatcccagcctttgccggctataatcaaaacagagtcactgatggactgtcccgaaagactggttccggcagcgcggaaagttaccggtatattatatctgtcggccagatagatcatttcgaatacttcatcgtcgtcgatcgagttaactacaattagaggaatcagtcggtagaaacccgcatctgtcccccatgccaggcgatggagctcgtcggtaaatattctatcctgtgggataaatcggctgatgtctcgcaggaattcgtcatagtttctttccgttttcattgtttctttgtttgtcgggcactcctcggtcccagtttttatttatacaaataatacttcttcgacagccggcggaagtcgtcaacgtctttgtaccaataatcgcggacgtcttcccagcggttgcgccgactgaaacgttcgcgtacttctttggagccgctgacgagatcgaacatacggaaacgtcctttatcggcatggtcgaatacggcccggcccggatagagtacagctatttcctgcatcacgtaaaactgtatctcgcttagtgcagctttattaaagtccacaatatgtacttgtacgccttgcagatgttcccctttgcctaccgaatagaagggtttgaggtgcatcggacggaatatcactcccggcaggttcagacggttcaggttatcagccaatctgtctgcctctatccaaggagcggcaaacatctggaacggaatggtataacccacaccaatcgacatatagcccagttcgccgagtatccccgaaacgggatagaagaaagcggaatgcggatgcgggatgtgtggggacgaaggaatccattggagtcctgtctgtacataatccatttttcgcttccaccccttcattttcacaacatgcaggttgcatggcctgcccaacatttgttctccattgagcatcagtgcaagctcgccacaagtaagtccgtaaaggtacggaattttaaattggctgacaaaagatatgtatccatcttctacgagattcccttctatttttaatccgcctatcggattggggcggtcaaggacaataaactctttaccattttcggcggcagcttccatagccactcccatggtgctgatataggtgaacgagcggcagccgatgtcctgtatgtcatataccaatacatcaatgtcttttagcatttcggggctcggcttacgcgttttgccatagagtgaataaacgggtagtccggtagtggggtcgttcgtgttatccactttgtcgccggcatgcacatcaccccgtacaccatgctccggtccgtacagagccactaagttgacattgggcgcttcatgaagaatgtcgatagtggaccgcaactgattgtctacaccggtcgggttggtgatcagtcctacacgtttcccttcaagacatttgaagttttgttcttttaggacttcaatacctgttttgatacggattcccggaggttttacacctggttccatcccttgggaaaggggagtattggaaacaaggataaaaagaatgagcaaaagtctcaatatacttcttttatgtgtcataatcttatcttttttagttatcctaccaatgtctggagtaactttatttcttctcctcggcaatattctcttttttcttcccataatcggggtctatcttgatgaaggcacatacggcaattgtggcggcacaacaagccattacccagataaagaagttttcgtatccgatcagttcctgtaaccagccggcggccatgcccggcagcatcatgcctaatgccatgaaagcagtgcagatggcatagtgcgccgtcttatgttctccgtcagagtagtaaatcaagtaaagcatataggctgtgaatccgaacccgtaaccaaactgttcgataaatacgcacaggttgatgatcacaaagttctgtggctggaagtaacccagatatacaaaggtgaggcaggtcagcgataggctccatgccattggccacaaccatttttgcagtcctcctttggctgcacaaataccgccgacgatgcctcctaatgtcagtccgatgatgccgatggttccgtaaaccaatcctacttcggcggtagtcagtcctaatccgcctttctcgacaggatcgagcaggaatgggttgatgagcttcactaactgtgcttcagggaagcgatagaatagcataaagaggatggctactccagcctgttttttgcggaaaaaagaggcaaaggtttctatgaatccattgaaaatggcgcttgcactgttctcacctactactgctttgtcactgtcaggtttcggtaatacgcatttgtggtagaggcaaaaagcaaggaacagtcctgcaaggataaagaaggtgatgctccatccgtatttaatactgcctgtccatatttccaggccgccggcaagcatcaccaacaaaccttgtccggcaattgtggcaatgcggtagaaggtactgcgtatccctacataaagtgcctggtcttgtacgttcagtgccagcatataaaatccgtcggcagcaatatcatgcgtagccgaactgaaggccaccagccagaagatggcaagggtggtctggaaaaaatttggcatgggtatggtgaaagcgattcctgccagtccggcaccaaccagcaactgcatgctgattacccaccagcgcttggttttcaataagtcgacaaacgggctccaaaagggtttgatgacccagggtagatagagccaggaggtgtagagtgcaatatccgtgttggagatacccagattcttgtacataattaccgaaatagtcattacggctacataaggtaatccttgtgcaaagtacagggtcggaatccatgcccatggtgatatggtcttgtttttcatgataagagtgtgtgtttaataaagtttatctatcgttgcaccgatgtagtaatgcaataaaatagtatcgtatgagtaaccttgctcgcccatgacggctgctcctatttggcaaagtcctactccgtgcccccatccggcaccggtgaggataaaccgtcccggtacgtcatccacgatatctgccttgtcgatgacgaaagcggaactgtaaaggtgagatgtagagagtgtacggcgtatttccagttccttaccgatagtcatggtccgtttgctccctctgatttttaacttgacaagccgtccggaggttccccgttccaccggaatcaggtcgagtatctgtccataatccatgcccgaacgtttcaggataagctcggaaagttcgtcttgtttatactctattttccaacgatagaagtcggtggtctcctgatcgtagttatttaaaacctgagacaatattttcttgtcttttgtgttacagaaagcttcgggtgaggttcgaatccattggtcggcttcggactctacccgtagatcgggcagtccggatcctgttttgctgtctctttgcttggaaagatacggatgcttgataccttcccaacaatattggaactcttcgaaagcaccgccgcaacattttgagaaacgggcgtcacaaatgtttccttcccacataagtacttgtccgcgggtggcagcgatggcttgcctcaccatttcggttgaggcacgggtgatgccttggtagcgctggcaatggtcgtcggcgcaaacgtcgaagtgggtgtgatcttcacggtcgtaccatctgataagctcctggtcggtctgtgtgaaagctgaatagaggctttgagatgccgtaattgctttgttcttatgaatttgggccaataaccagcttcttgagatcactgcatgggccttcagcagttcgaggcttgccgttgcactcatctccgatgagatgacactggtcaggtagtcttccacatgaattacattgatccctgtcagcttttcgttctcgacaatgattttcaatgctcccataaagcgttggtcttctttccgttcccaatggaagttaatgccgatggtgacattcagtaattcgaaagcatcactttcttcgtgcatgggttcaaacagcaattcgtcataaaggtgtccttgccagcggatttgtccgtcaacataggtcacgacctgtctgccggcaatctcttttcctttgatatggtaagagttcagcagtatgaattcgatttgaggttcggacaaaatgccgacctgtactttaggttctttcatgatcgttgttttatgcgttctatcaatgcacggaagtctgccggtttcaagcatacctcactgagaatgtcggcaatatcatttgctgtgattttctcaaagtctttctccaatggagtgatgaaaacgccacccatatctactgacgccgggctgatcagtatattggtatctccttgggccatataacatgcagggcggtgtctggcgcggggaaagatacagacaatctgtttgcctcgttctttccatgccaatacattcatcatcggctcctcttcgccggatttgagattcatggctccgtatacggcgttgaacagtgtgacggctgcctctttactttccgattcaattaagagtgttgtacggggagagtcgtccagtgcccatagagtggcagcttcattggtaattattttctctgcccttttctccttccattcttgttcgatgggaaggaagcctttgctaccggcctgaaaatgcatatgatcgggggctgatgcgccacattgggggccgttgtagaagacaatataatcttccgcacaatcagccagatcgagcatatcagcaaaacggtacaagatgcgctgatcgacgtgctgtagttcgggaactgtcaggtgcctggggaatatgggaaacggattgaccaatatctgataatggtctccgaaaggaatccccttttgcattggcggaagatgggccggacacaggaaacacttacgttcctgaatcgacttgctgtctactttggctgccgatgaaacaatgcgtgccgggttgaactgcactttgtaaagacagccattcacttctacctcttttacacgtacacgcttcaacgcatcgtaattcttttgtgccatttcccacgaggtgagctgctcattcagcaggttctgtaattccttgttcatctttgttttttgtttaatgcgatccgtgcctgcaattcccaggtacggatgcgatctttgtaaaggttgtgtccattcatcttcacaatgtcgagtgaggcgtccgagttatcgtcccatcggcggcagaggtagacaacttcgtatatacggccgatctggtagcggcgtgagaaattcagtcccaatgcgtaatcttcaccatagctggtattgggcactttcacttcgcggagcatcggtgtatagaatgcacggggagcacccagaccattaatacggagcgcattgttgcgtccgttttccggggtccactctttatggtcaatgacgcccggcggaatcatgttcatatcgaagtctgtcatcatgtaggtgcctactaccatggcacagttctgttcgtagaaggcattgaccatcagttgcagcgctctctcgtgagcatatacatcgtcactgtccagttgcacggcaaacttgccgcacaggggatggtacacgcccaggttccagcaaccgccgatacccaggtcgttacgctcgggaatgaggtgaatcaggcggtcatcctctttatattcgtcgatggcttcggtagtgccgtcggtagaatgattgtcgataacgatcagattgaacttgaattctgttttttggctgagcaccgaacggatggcatcgcgtatggtgcggatgcggttacgtaccgggattatcacggaagcttcgtattcaaagttattggcactgaactctatcttttcaaactccggtttcagataaccgcctatctctttcaggtgttcggtgcaagttgcttccatttcgatctgccgttcacgattcttcgggtctacataatcgaatatcttttcaccactcttgcgggtatcattctctatttccgagtagagatattcgttgatgtgtaccagcggatatttctgcgatagtttgaggcgcaggtcatagagaccggcgaagtcgtaactggttttcatcctcttgacagtctctttcagggctgaggccttgaataggagtacagagccgaagtcaaaatcgtcacggaggcttccgaactgatagtcgatgacaggggcattgctctgcttaccttccgtcacctgatagtggtcggcatataccatgccggctcccgagtctttggcgatatgaatcatccgttcgagtgcgaacatgcccaactcgagtgtggtatgtttggtatagagtaatgcatagtctgcatcggaacgctcagcaatggcgtacatggcagcactgtcagtgagtttgtccacatagagcagttcgcatcccggcagtggatcgatgtcgggagaggtggcgaggaggtagattttcttcactaaatctgtagcctgtaatccttgaactgttttttctgcttgtgccactcccgcataggggatgaagcaattgattgttgattccataagcgattgacggtctctcccaaaatctctcctacattggaggggcggagggatactgccgattattattgttattatttcatttttttctctctttattgtcttccggcctgtcactaaggcaggtagtctctttttttattcatccgatagatgcataattccgataaccggaataaagcgttcgtctcttttcacgatcactccattcactccgcatgctcactccatttacataccggagtaaagagctttacatgccggggtaaaaggttttacacgccggggtaaaagccgttacacgccgaggtaaatacttttacatccgttcgaaaaagccggtaaatgtaacgcgttgataaatagagtcatttattaaactacgcatttaccggatgaacctctctattctcctcattacgggaggggagaacagttgagtcttcccacttcgccgccggtagctgtaaacagtacctggtggcgactgacgggaatcacggtattaatcagtgaattaccgatcttatgtttccacagtacctgcccggtgcttgcttccagtgcaaagataagtccttctttggtactactgaacactacgccgtctttttccatctgcatggatggggcatgttcatagccgaaaccgacattagaggcccagagctttttcgggacgtctccgatggtggagtaacagactacgctgtcattcattgttttgctatagatcctttttttgtcggcggataatccgatggtttcgcgtaccatcgactggaaggtacgccatacagtttctcctgtctccaggttgatggcagtcatggcacgttgcgggtcggtgatgaatacttttccgtgtgcagctaccggccatacggcagcgggtgagaagtgcatgcgggtgagtcctccggtccatttccagagttccttgccgttagtcttgtcaagggcatagagcgtattgtcccatgcaccgaatatgactttgtttccttctatcagaggttttgtctcaacatagcccttgatgccggcatagctccacaacacctttccgcttttgatgtggatggcacggaaggtggagtcgctggcaccgatataggcaactcctttttcaatggttacggctcccaataccggttctcctgcggtcactcgccaacgttctttaccggttcgggcatccaggccgtaaatgttatggtcggcagagccaaagacgacgactccgtcggctacatcgggagtgcctacaatacgttttccggattggaaattccacaatttctgtccgcttttcaaggtatagcaggtcagaaaacccaagtcgtcaccgacatagactttgtctttccagacagcaggtgagcagtaaataccggctccggtctgcactaaccagtctgctttcacttgtggatattcttcgttcaccgcgaaactgggatatttcactgcttttccggaacggtcgtaataaggtttagtgagtgacaaggcagcccatcgtttcatcggttcaccgatacgctgttcgtaagtgataatagaatccggagtgacatcaaatatgccataaccgcctatgccatctttgtcccgcaggttcgagcgggtgagaatgcccggaatcccgtcgtacgagaggagacggttacggtgatagtgccctccgataaaggtgcggatattgtagggacgcacggcatcggtgacatcataccagttgtcaacatctccatccagcatggggtagtgggtgaccagaatcacaggcttgtctttccctgctttgttcatttcctgtttcatccatgtgatgtcttgcggcactacatgcccgtaggccatgcgcattagcggaccggaattgaacccaaggaacaggaagcctttgtgttcaaattcaaatcgctctcctccgaaaatatcgctgaatgcggtgcatccggagtcgctccatttggtttcgtgattacccagtatgacatagtatttcaccttcaactggtcaagtatggactttacaagcaacatggtggcacggtcaccttcttcggtgaggtctccggtgactaatacaaagtctattcccggcgtggtgttaatctgttcgacagaacgcttcaaatcttctgccggtttcgggttgttgggactgaggtgtatgtccgtcagttgtgcaaagcggaaagaacctgttgcctgtgcctgcacggcggcaggcaacaggaaaaacaaaatgattacgaatatagaaagccttctattcatagatgatgattttatttattattactacacttttcagtttcttgtcagtggaacggttgctgccttgatgagggtatgcaccctatacgtgcagttactccacctgtgttatcattgttcaaagaaagccagtatggctttcattaactgttctctctcttcgggggtacgtaccgattcgaacgggaatcccaatacacaggtcttataatctcctttataggctataccggcactcaggttgttttccgaatatcgcaatacggtgaatgctccccggacggccggttcgatggcatcgggcgactctacgacatacgattccggattcaactcctgatggtatgtgtaatttcccttgattgtagggaatggggaagcaacgcctttcacttttccgttacgggcggcttgtcctgtgcgccatttgtatttcaatacttccatcgcgaacttcttgtctttttcgtccgctttcgctaaacgattatcccataggtccgatgctacataggctcccgatacgaagaaattaccccctgtccggcaataatcagagatggcattctgcatttcttcgctaaaagtcttaaactccaatggttttactccttcccgtcccatcttgctctgacattgtttacctaaaatcaggtctacgtatttgtagtcgttcatccgcaggacaggaatgccccctgacgcagcatccgtctggttggcgatactatctctcccgtttttcttcttgagtgaagagcagggagtgagaccacacgatacaaatgaatatcctgctttcagaatcgcctctccatgtacagccggatagtcgaatgagtttccggcaattaccattgtctcgtgcgtaccatagctgtcgccgaatccggaggcgtcgtcgtccatccatgggatctgtcgacgaaactctttcatcggaccaatatagctgatgtctgtctggtaaggtactccgtggtccagttcgtcaaggaatccggccagggtgtctgcatctgccgtaaagtctgccggaccactgactcggctaaacccgttcactaccagtactgttcccttttcgttgagggctttcccgatagaaagaatttcggacgggaaactttcacctcccttgttgagggcggttactttgaaactgcaaactacgcctgaagggatgtttgtctggtaatccggagtgtctacgatcacgccattatcaaagtctccttctccaatgcgggtatatacgatgtattggtctgcttttgcggtaggttccagcggatcgtctaccggttgccatgaaagcattatccggttgccctctatgaagcgcaggcttatagaatcgacgggcaaaggctgtactacataatccattttatattgggaacagaggaattgcagcattcctttgtagatggcacggctgacggtgaaacgaaaacgaggatccagtccgtaacgcatgtcggcaaagttctggtgagacaggagttcaagcaacatggttggtactcgtggcacacgggcctcataataggactggttccacattccccggcgggtccattccggttcatgcaaagtgcggatgtctttcacgatgttggactgtatcaggtcgcacaagtcccgggaggcataccgtgaagtgccatttgcatatatcccgtcataggcagaggtttggaaaatacctaatgtgccgataatggtgtcaccataggtggtgccggcatctgaatggaaggcgaaagccatgtctatgggaatattcagtcctttttcagtggggttggcagccgaacctccggcgagatagttcacccaaattccacgtgatttatagtcatcagtataatcgttcttaccgcgactgtctgagtaaacgctatccggtatgcccgcccattgcatccagtagcgtgctgcttcgcagaaacgagggtagttactgatctcataaggataatctacacccccttcttcagagatactgcgggcgatgtttccataaccaccgcctatttttacagcatcggctgtcaccagacggcccgctttggaggattggttgctgaggacgactttgtgatcggttttgcttgcactgaaactaaaagtgcctaagtagatccaggttcctcctcccatctgctggtttactttgaactgtgatgtgccgccttggtgatagacggtgtatagggcatcgtctgtactgttgtccaccgttttataggagacataaacagcatatcggcctgaccggggaatttcggggatccattcggcaatgcttgcggttcctttcttaatcgtttctgtctggcggtaactgccttcgcaaaagggattctcaaagtctttgtacgttgccctcaggtgggcgaatcctgtttcggttccgttgctccatgccttactgccgttttgttctgtataaattgagtgtccgtctctgcatccatcgttgtcgacaataatttcagttgtctgccagtctctttcacgaggaagaaggacagtcgccccggcattttctaacatcggaacaaggaaagggagtacatagctttgagtgtagagatcttctacggtctgaaaaatacgtgcacgctgccactcccagcgggttagcttcggttcgtaataaaagccgtgactttgccataaagcgatgtgccggttctgtaatccgtttgtgggggcatacggagcagataaccgggtaatcagggggttgtctactttgtggctgaatgtcagagttttcatcttgccctttttacttcgaagtgccagggggatcagttcttcgatgacatggtggtctgtccggatctgtaatttccgtttgctcaactctggggggagcagcgcttttacgctctgatagatttcggctacgttgttttcgcggaaaggaatgtatgaacagttcatgttagcgaaaaatatcagttcgttttttttcatattgatagaatcgatacggattttcccgatagaaacttctttccgggcagtttcattcaggagctcacctacttgggagcgtaggtctttgggcaggtcttgcgctgctgcggcttgtgggaataagccggctgcaagcagcagaatcagggaagtgcgaattggtttcattgtgatgttaagttaattggttttcttaatcaggaggcatagtcctataaaagtgaacaaagcattaaatatcagtagttcgtaactgaattgataaccattgaaccaggtctccgagttcttttgcaaaatgaaacagaggatgggtgagaggatggctaccagggggatatatcggtcacgtacttgttttttagtaaaaatgccaaaggcgaacaggcctaaaatagggccatatgtatagctggcaaggatgtagacagcatcaataacgctggtattattcagtagattgaatacgaagatgacaattcccatgacgaccgccatgccgatatgtactcgtttacgtatcttttgtacagtattttctgttttccctttgcttcccagtatgtctacggtgaacgaggtagtcagtgctgtcagggctgatcctgctgcggaataagctgctgaaatcaacccaatgatgaacaagatgcccacaatggctggaaaatatccacctgtagcgatcatagggaaaagctcgtcactttttgccggatttgtgatgccctggcgtgacgtgaagatgtagagcagtactcccagcatcagaaataagaggattatgaaaaattgggagatgccgctggtaatcatattcttttgtgagtctttgaagtttttgcagcttaggttacgctgcatcatgtcttggtcgagtcctgtcatggctatcattgtaaacacaccggcaagaaactgcttgaagaagtaacgtttgtcatttacgtcgtcaaaaaagaacatacgtgacagggaactgtcggagatactggaaatcatctctgtgaaactgagccgcagatcggtggcaatgtagtaaatacataatacgacggatactaccagacagaatgttttcagtgaatcagtccaaatcagtgatttcactcctccacggaatgtgtagagccagaccaatgttactgtgagaatgacattcaggatgaaaggcatgtgaaaaggttcgaaaaccagaaattgtaatgtgaggcatacgaggaataaccgtacagctgctcccagcattttggagatgaagaaaaaccatgctcctgtcttataagaagaggttccgaaacggctctccaagtactcataaatggataccaaattcatccggtagaacaagggtatcaaaacaaaggctataacgatttgtccggttacaaaaccaagtaccatttgcaagtatgagaaattactgactccaaccatgccgggaaccgatacaaaggtgactccggatatgctggaaccaatcatggcaaaggctaccacataccaagccgatttgcggttacccacaaagaatccttcgttatcagcttttcttcctgcaatgtatgaaatggtaaacaatatcaggaaataagcagcaatagtgattaataccgctataggtgtcatgtttttcagattaatgaatataatatttccggttaagagttaatcaattgtctggatagagtagataaggctttcgctgtactttgaacttttcgacatcctctttccatcttgcttttatttcgtcggcatttttgccctcttctatcattttacgtacatagtccgtaccgatcagcaactcaaaaaatggtctgaagaaatggtcccccatatttagattacgataggcatcgattatgtaggttaggtttactccttttttccatatatcttcgtcgctgagattgattagatttactccatgacacaatttattgagttgtggtgggttctttgctcctgggacacttcgaggagtaaaactgtagttgtatccggtcatattaggatgtccgtaaacttggaaaggtaaactggtcccgcgtcccagacttaccggggttgcttcaaagaagcaggtagaaggatataggtagatcgctttcatattcggcaggttaggtgaaggaggaatgggcaggcgatacatcgtctggtgagtgtagttcttacaaggaatgactgtcacatcacaagtccgtgaggagggcaaccaaccctcaccgttgactatcagggctaactcacccagtgtcattccatgtacaatgggaataggtaatccgcctactcctgatttatatttcatatccaatattggtccatcgacataatgcccattcggattggggcgatccaggataagaaccttgcggttgtattcagaacaggcatccatcagccgtaccatggatatgtaataagtatagaagcgcagccctacatcttgtatatctacaatcaatatgtcgaactttcgtatggaactctcactgggtttcttggattttccatcgtagagagaaagaatggggactcctgtttttgaatctactgtactggatacatgctcaccggcatcggcattccctcggaaaccatgttcgggagagaaaatagcgactacattgaacttgttttccagcaaaacatccagaagatgcttgtttcctatcattccggtatgattggaaaaaatagctattcgcttatttttcaggataggaaagtattcattggtttgctcggcacctacaattacctccttcttttgtgcctgacaaaagagagtactgcataataaagtgagtataagtaggatctttttcataaaaatagtattagcaggaatttctttgtagcaaagatagtctttattttaatatcaaaaacatatattcagatatattttatattataatcaataatttgcaaattgaatctttatctgaagctataaggtaaaatataaaactcttcctatttctatggttcaaatcgttataggaatagaatgggctttgtattttgctgagtatccctgattaccaaccggggatgttgaggcctaattgcggattttacgcaattgataatgtcttaaagtataattctccgcagcctgtgccattatcatatcctaagagttgttcataaaatgtattcacatagccggatatatttctttcattagggcatttagttcatgagaattgccacgtactgagttctgatctactctgtatcttcattgacttctgttggggggagaagtatttatttttttctccctgggaatttcaatacactgtcggcaatctactggtttaatggctgtattattgaagttaaatatatagttggcatttgaagttaatcctttgataatatttgctttaaggaaagcttccatatgggtataagaactgttggtttagtcatttactgtttgcttgaggatatgaggcaatgttctttatgccaacttcctgataagtcccattagaacttatatgaaaattagtgtacttatatatctgcatctgttctgagtagtgaatcttctaattagcactaataatatgcgtccaatccaacacaggtcctgtaagtatctggcaacctgttttttgatattgatagttttaaaataagtcataatatatcaatgttatgttaaatcaaagtgtcttctaatgaactgatgacttctattgcatatagataatcatcacattattatatatataaaagattctcggatattaggttatggataaaagagtatattagataatattgtttttgacgatctcaaatattcggcatatgcagaaaaaacacatggatttttctaccaactataaataaagttttggggtggttattgcgttatagaaaaactttccgatcaaaataaattaaattacaaaaaatgttatatatttgtatccaaatcaaaaaaaaactgcgaaatgaaacttattgcggaaagtggttctacaagaacagagtgggcattggttgaagacaatcatctcgtacaacgtgtgtttaccgaggggttaaaccctttctttcagaccagaagagaaattagcagaagtgtcagactaggattaccggagtctttcttcaaaaagaaactggaccaagtatattattatggtgccggatgtagttcatatgaaaagaaaaacattttaggtgcttccttagtagcacagtttaaaactcctatccaagttgaaagtgacttgttggcagcggctcgaggactattcaaatgtgaatctggaattgcctgtattttaggtaccggatcgaactcatgtttttacgatggtaaaatcgttgtcaaaaatgtgaaagctgcaggatatattctcggtgacgaaggcagtggagctgttctcggaaaactatttttagctgatcttcttaaagggttagctcccaaagaattggcgagtgaattccatgaaaaatttcgcatatctgccaatgatgtgatggaatctgtatataatttacctttccctaaccgttttttaggtacgattgcatattttttaggagattatatggacaatgaatacgtatataatttgttaaccaataatctgcgaagcttctttaaccgtagcgtgtgccaatacgattatatgaattatcctattcggtttgtaggatcacttgcctatgcgtattcagatactttgcgtaaagtagccagagaatttggagtggagattgacgttatagaagaaactccaatgaatggcttaattgaatttcattcaatgaacattgaagaaccttaaaaatacacagctatatctaaataatagtttcgaactcttaaataccgcatttttatctgtcagtatgagccaaaactcttaaagtcaaatcactctctatgtgaatatatagatataaatctaaaatataataaatatttgttcttgatattaaaataatatatatctttgctatgatgaaactcggaagggttttgaacctttgttaataatggacaatttatctcttaaaagaaccataaagctaattgacattaattaaactggcgaaaaccaaagttctaatggaactttaactcagttaataatagagataatataaaaattaaaacctttaaatgacaagaagcctatgatgaataaacaacctcttgtggtgggatgattcccacttcctaattttaccttacctgcattttgagaaatcaatcgattaacaaacaatttaatcatctatcttttatgaatgaagatcgcaagaaacgaggactagcaaacagcaagctccttacggccgtggcaataactgctttgtttataggcagtggtaatgcggtggctgcttcaactgcttccggcagtgcttatgaagtgacagaacaattacagtcgcaagctattagtggtgtagtgactgatgcaaacggagagcctgttattggtgccagtgtttcagagaaagggacaacaaatggtactattacagatattaatggcaaattcagtttaaatgttaaacccggggctgtcttgaaagtcacatttgtgggctataagccacatgaagtgaaagctacaagaacaatgaaaatcatcttgaaagaggacagtgagcttttggatgaagttgtcgttgtaggttatggcactcaaaagaaagagaacctgacaggtgcagtggcttcagtagatgtgaataaaacactaagtagccgtccgattgcggatgttggacgtggcttgcaaggaacgacaccgggactttctgttgtaatcccgagtggagaaattggttcggatcctaccatgaagatccgtggccagattgggtctattaacggaggttccgctccgcttattttaatggacaatgttgagattccaagtattcagatggtcaatccggacgatattgaatctatttcagttttgaaagatgcggcagcatcttctatttatggtgcaaaagctgcgtttggtgttgtattgattactactaaaaaaggagctaagcaggaaagtataaatgtgagctactccggaaacttttcttggcagaatatttccaagaaaatggagatgggaggaattgatgccttggactattcggtcgaagcttttaaacgtgtgggaggaaccgtagccggtgcatttgttcagattactgaagagggtcttgtcaaagccaaagagtgggaccaaaagtatggtggcaagttaggtcctaatgatccttacgtgtatggtcgtgactggtatgtagacgctaataaccgtaagattggtttgagaactttcgatccatatgattatatgattaaagagtggactccctcaatgactcataatctctcggttaatggtaaaagcggacgtacgacttataatattggcttcggttatctggatcaaacaggactgatgaaaccggcgaaagatgatgattttaagcgctataatggttctttgagaatcagtaccgatattaataaatatgtcacagtgagagctggagccatgtattctaaacgtgaaaagagatacgcctatgctacctcctctactactgctgatccttggttgtatttataccgctggggaccgaacatgccgatggggtatgatgatgaaggaaatattatccgcagcccgcattcggaagtagctcaagccaatacggcatcacgtgcgtacaactatataaatgtaaacgtaggggctacggtcaatattatgaaaaactggaagttggatattgactatacacatgctaccaatgaatatgtacttaaaactcctggtacccgctatacagctcttaattcatggggtggagcagtagctaaaaatgatgccagtggtaatcgtatttatgtcaatgaagccggcgaaacagttgctgccggaactccgggagcaatgcctgcctataaattaggtatgacagagtatacggctcatggagcgaatcccgaccatatgtatcgacgttctgagacaacgaaccaggacacttggaatatttctactacatatgactggaaagtagataagaataatgcgtttaagttcttggtcggcatgaaccgggtgacttatgatgaagaatacaactggtcgcggaaaggtgacttatctgatatttccaatccacagtttgacctcgctgtaggtttacaagaggcaagtggaggatacgattgggaggggcaactcgggttcttcggacgtatcaattacgctttaaaggatagatacttattggaggctaatctccgttatgatgcaacttccaaatttccggataacttgcaatggcgatggttcccatctttttcagccggatggcgtgcaagtgaagaagctttcatgcagtggatgaaacctgctgttacatcattgaaattcagagggtcgtggggtattatcggtgaccagactgtatccaattctttatatattcccaccatgtctaccggtcaactgaattggctggacgagagtggaaataagctggtttatgtaagtacacccagtgcagtggcaagtaacatcacttggcaggacattcagactgtcgatgttggcttggatgcacgttttctggatggcgaactcggtttaactgttgactggtatcaacgtgatacaaaaaatatgattgtcccgggtgccggtgttactttggcgtttggtaccggagccccgaaaggaaattttggatctttgagaaccagaggatgggaaatcgcacttgattacaatcaccgtttttctaacggattaggtataaatgcgatggctaccctgtctgatgctgaaacagagattactaaatatagtgatacccgggtcgttagtgattggtatgttggtaaaaagtatggagagatctggggatatcagacggaacgtctatatcagaaagatgatttcgtatataatggagatcagattgtaacaacttgggctttgaatggtaaagaggttgctcagggaactaaaggtgctaaaaaagtgaataaactgaaaggggataatcctgtttatcaggactttttgcagagtggcaactttgtttttggtccgggtgacgtaaaatttgctgatttgaatggcgacggattgatcgattccggaagtggaactgtcgatgatccgggtgaccgcaaagtaatcggtaattctactccgcgctacgaatatggtttccgtttgggagccgactataaggggtttgatttttctgtattcttccaaggtgttggcaaacgcgaagtttggggtaatggttttcttgctattgccggatataactcttcggatggtgccatgcctcaggctattgccggaaattattggcgggaagaccgtactgatgctttttatccgcgtccttacaatttagccggttccaataactctttgaatatggtaactcagtcgcgttaccttctcgatatgtcttatttgagaatgaaaaatatcacgataggttattccatacctgccgatatcctacgaaaagtgcggatgcagaaagcgcgtatctatatgtctttagagaactttgtgacttgggataatttgaatggtctgcctatcgatccggaagaggtacaaggattttcgatgtttaatacagataattataattcgggtcgtaccggtgtcggaactcctacttttaagagcttgtccgttggtattcagttgaatttctaaaataaagaagaatatgaaaaaatatatatttactttactttcacttgccgcactgagtttcaccagttgcgatgatgtgttagaccgtcctcagttgacgaaaccggttgatacgaactattggcgaagcgaaacagatttccgtctgtatgccaatgaatgttatcctaattactttgttggctataacaatacatggggagtggattatgctccgttgcgtggatattatttttcggatgataacgcatgggcaggaaagcagtctgtgatggaaaatgccgttccgtccagcaggggatcgagcagcttgtctaccggtagcgacctttggttgactaagtatggaagtgcaacttggaattttgcatgggtacgtaaaattaatacgatgatcgacagacttgatatgtatggcaaagtaaacctgacagaagaagcatacaatcactggatgggggttgcccgcttcttccgggcattcgaatatcatcgtttggtctggtcttttggagacgtcccctattttgataaggtttttgtggagacagacgcagctcaaatgtataaagacaggacgccgagagctgaagtcatggagaaggtttatgacgatttgaagtttgcttttgagaatcttcgtttgtcagacggtgcgatgtatttgaataaagacatagcagccggctttattacccggattatgttgtatgaaggcacttggcagaaatatcataatttagatcaggcattggcaaaaaaatatctggaatttgccaaggaagcgggtgattatgtgattggtaccgggaaatatgcgatttccggagatttcagaagcctgttcggttctcaggacttgaagggacacaaagagatgttgatgtacaggcactatgatgctgcgaatgcgacacatcacgtggcttcttattcgaatggttacgaggggcagtccccgtctcctaatctggcattggctaagtcattcttatgtaatgatggtaaaccgtatgaagcatcagcagtgcctgatgccgcgaaactggatatcaaacacatggttaaaacccgtgatccccgttttgaagctaccttctgggatgaaccgagagtacaggccagtacgcttttatacgcttgcaaatttatcgaccgcaccgggccaacatactggaatgctgcaactataccaccccagtatgggagtatgaccaacaccaacgatgctcctgttatgcgttattccgaagtgcttttgaactggatagaagctaaagcagagttggcaatcatgggagaagcggcagtcacacaaggtgatattgatatttcaatcaatgcgattcgtaatagagatctcgacgttgaggctattgctaaaggggtacagaaaacagctccgatgaaacttgccgatatcactgaagcttttgcacccgatcgtgatgccgatgtgcctgctttgatttgggagatccgtcgtgaacgtcgtatggaatttgtatacgagcatactcgtttggctgatatcagacgttggaagaaactcgactatatggataataataaatacccggatacaatgttaggattgtggattaatctgaaagaagaacttccttcatatctggaacagggtaaagacggaaagtataccgcttatcaggttcgcaagatggacggtaccgtggttacttatgatggtagtaatgctgacgatatggttggcttctttgttccgctgaaggcggtagcccgtgatgtgtttggcgatgaatgttatttggctcctgtgggcaaagcacaaatcgatcagtatgccgatcaaggctataaattgagtcaaactcccggttgggagaataagtaaataaaaaggggaagcaattgcttccccttttttgatatgaatattttggcttatccgatatttccttctttaatcaggtattcggcaatctgaacagcgttcagtgcggcacctttcttaatctggtcacctacaatccagaaagtcagtccgcagtcattggtcaagtctttgcggatacggccaacgtaaacagggtctttgcctgccaggaacagcggcatcggatagtctttttctgccggattgtcctgaagtaccaatccttcgcctttggcaaaagcttcacgagcctcttctacggaaatagggcgttctgtttctacccagatgctttcagaatgtgcacgaagtgccggaacacgtacgcaagtagcactaacctttacgtcagaatgcatgattttgcgggtttcgttaaacatcttcatttcttcttttgtatatccgttttctgtaaatacgtcaatctgaggaatcagattgaaggccagctggtatgcaaacttctcaacagtgacaggttcattggccaaaacctggcgatactgttcataaagttcgtccatagcggctgcgccggcaccactggctgcctgataagtagatacatgcacggtttttatatgagaaagctcttcgatggctttcagtgcgacaaccatctggatggttgtgcaattcgggttagcgatcacgccgcgcggacgatctttagcatcggctgcattcacttcgggcaccaccaaaggtacatctgcatccatacggaaagcgctggaattatcgatcattaccgcaccatattgggtaatggttttctcgaattccttagatgtgcttgcaccggccgaagtgaaagcaatgtccacccctttaaagtcatcgttgtgttgcagaagtttgacctcgatctgtttaccgcggaaagtatatttggtcccggcactacgtttagagccgaacaaaactaactcgtccaacgggaaatttctctcatcgagcacgcgcaggaactcttgtcctacggctccgcttacgccaacaatagctactttcatctttttcttttgttttatgtgaatactcatcctctacaatttaaatcaatcgtaaggatttggctgcaaaattataacattttgcaatataataagcattttagggagaagatttctcattgaaaatctctttcctaatgaattggcggtgtgataacttttttgttattttgcagttaaatacaaaaatcccgatatatgcactggtttgatctcagtttacaacttccgataacagaccctacatgggtgtttttcttggttctgatcattattctatttgcgccgatgatactgggacgcttgcatatcccccatatcattggtatgattctggccggggtagttattggtgaatatggtttcaatgttctcgaacgggatagtagttttgagctgtttgggaaagtgggactctactatatcatgtttctggccgggctggagatggacatggaagattttaagaagaaccggaccaaagggttggtcttcgggtggtttacatttattattccgatggcattgggcgtatggagcagtatggagttgttggggtatggatttaccacagctgtgctcttggccagcatgtatgcttcccatacattgattgcctatcccattatcagtcgttatgggctatctaagctaagaagtgtaaatataacgattggagggacagccgtaaccgttacattggctttgattattctggctgtcattggaggtatgtataaagggactgtcgacggcatgttctggattctgctggtggcaaaggttgcattcctgagttttttgatcgtattcttttttccgcgtatcggccgttggtttttccgtaagtacgatgatagcgtgatgcaatttgtttttgtacttgcaatggtgtttttgggtagcggcttgatggagtttgttggcatggagggcattttgggggctttccttgcagggttggtactgaatcgtctcattccgcatgtctctcctttgatgaatcgtttggaatttgtcggaaacgctttgtttattccctattttcttattggtgtggggatgattatcgatgtccgcactttgtttgccggaggcgaagctttaaaggttgcggtagtgatgaccgtattcgctactttgagtaaatggctcgctgcctggattacacagaagatttatcgtatgcagcccaatgagcggagcatgatgttcggtttgagcaatgcgcaggcggctgctactctggcagcagtactgatagggcatggcattataatggagaatggggaacgtttgctgaatgacgatgtgctgaacggtacggtggtgatgattctctttacatgcgtaatcagttcacttgtgaccgaacgctctgcacgacgtttcgctttgcatgaagagatgcagttcgaagataacaaggagaaaatagaacaggaacaaatcctgattccggtagcgaatccggatactattgaagatctgattaacctcgcattggttatcagagataccaaacagaagaaagaactgattgcactcaacgtaattaatgataataacaactcggaaaataaggagttacagggtaaacggaatctggaaaaagcagcaatgattgctgccgctgccgatgtttcggttaatatggtgagtcgttacgaccttaatattgcttcaggcattatccataccattaaagagtatgatgcgacggacgtagtaatcggtctgcaccgtaaggcaaatattgtcgattcattctttggtaatctggctgagagtttgctgaaaggtactcaccgggaagtgattattgccaagttccttatgccggtcaatacacttcggcggatcattattgccgtacccccaaaagctgaatacgagaccgggttctctaaatgggtggaacatttctgccgtatgggaagtctgttgggttgtcgggtacatttctttgccaatgagcagaccctgatgcggttacagcagttagtgaagaagaagtatggaagtactcccaccgaattttccagactggatgaatgggacgacctgcttttgctgaccgggcaagtgaattttgatcatttgttagtgattatcagtgcgcggcgcggatctatttcgtatgatcctgcgtttgagcggttacccaaccagcttagcaaatatttttctaacaacagcttgatcatcctgtatcccgatcagtttggcgagcctcaggagatagtttctttttctgatccacgggggtacaacgaatctcagcattacgataaggtaggtaaatggttctataaatggttaaaaaagaattgatggaaaactggcagcagagaactaaacttcttttaggagaagagaaaacggaacgtttaagaaaatcacatgtgttggttgttgggttaggtggagtaggcgcttatgcggccgaaatgatttgccgtgcaggtgtaggccgaatgacgatagtggatgccgatactgtgcaacctactaatatcaaccgccagttaccggctacgcatgccaccttgggtatggagaaagcaaaggtgctggaagtaagattcagggatattaatccggagatagagttgaacgtattgcctgtttatctgaaagacgaaaatataccggagttgctggatgcctcaaaatacgattttatagttgatgccattgataccatcagtccgaagtgttacttgatttatcacgctcttcagcgccgtataaagatagtatcgagtatgggtgccggagcgaaaagtgatatcactcaggtgcgttttgccgatctttgggatacgtatcattgcggtcttagcaaagctgtccgcaaacgtctgcaaaagatgggagtgaaacgtaagttgcccgtcgtctttagtacggaacaagccgatccgaaagcagtgttgctgacggaggacgagagaaataagaaatcgacttgtggaacagtgagttatatgccggctgtgtttggctgttatctggcagagtacgttataaaaagattgtaagattatgattcatttagaaggtataaccaagagtttcggttcgttgcaggtgttgaaagggatagatctggagatagccaaaggagagatagtaagtattgtaggtcccagtggagccggaaagaccacactgcttcagattatggggactttggatagtccggatacaggtacgataaatgttgatggtacgaacgtaagcaagatgaaggagaaggaactttctgctttccggaacacacacattggctttgtgttccagttccatcaattactgcctgagttcacggcattggaaaatgtgatgatccctgcatttattgcgggtgtgtctaccaaagaagcttctatacatgccatggagatacttgattttatgggattgacggagcgtgcatcacataagcctaatgaactttcgggcggagaaaaacaacgggtggctgtagctcgtgcattgatcaatcagccggcggttattctggccgatgaaccttcgggaagtctggacacccataacaaggaagaactgcatcaactcttttttgacctgagaaaccggtttggacaaacctttgtgattgtgacacatgacgaaacattagcaaaaatcaccgaccgtacgattcatatggtggatggaaagatcatctgattattcaaaacagacgtaatgactgatccgttccagatcttgagtcgtgaattcttcgtaaagggataattgtttcaggctcttcaatgttctttttttctttctgtattctacgattactttggcttgataaaagttgatatagggatgagctctgagtcgttcaatgccggctttgttgaggtttattcgttgagtcgttccggctgtcacacagagccagggacggagtttatccacatcgagatgtatctcttccaactgggctatatcgtagaatccacccaatcgtttgcgatatcctgttatcatacgcgcaatcccactaccgatgccgggaatctttttcaattctgtagtatctgcctggttcagttcgactactgttccggcttcgtatttaaagtctttcagtgtatccttctccgctttccggatgtagaggtgaaatgtatctttttgttctatgatcggagctatacggatataaggctggagagtggcgtattgttcttgtgtcaatccatatactttccggaagtcttctacccggcggaattttcctcctttatttctgtatctgagtatattctttgccatccatgcaggaatccctaagttgagaaatcctgtagaatctattgtgttaggatcgaaaggtgccagaactatttcccgtcggtgccggaagtggctgttgtgtgtatatcctctttcttttttctcttgtatggaggccatgaactctgcatattccttcttgaatttctcagtatcgttcgtggcggtattctctttgtcgggtatcaaccatccgccaatgaatatcagtatacacaaaacggcaagtatcaggataccttgccgttctgtacgtgtaaagtaaaagaagtctttccacatttttatttcagcagccccagttcattgatgaagattactgaaatggcaatcggggctacatatttcagaataaagataatcagtttatagataggtactttcagtgtaccattattggttatttccgaccagacaagcttcttgtccagataccatccggtaaagatggagataagcaatcctcctaacggcaacatcagtttggcggtcacgaagtcaaataagtcaaacatgcctaatccgaatatggtgaaatctttggtaactcccaaagagagtgaacagagtatccccagcagaatacaaccggcagtcactaaccgggccgcttttccccgggtaaagttgaattcttcgtgtaagtaggccgttactacttcatgcaacgagatggtagaagtaagggccgccaatgccaacaatacgtaaaacatcaccgaaaagatgtatgccaggacaggtattccgctgaaagcctgttggaatacattgggcagggtgatgaagatcaagcttggacctgcatccggctggatgcctaccgagaaagccgcagggaagatgataaatcccgccagtacagctacaaatgtatcgataatgcctacactgaaagcagtccgggttaggttggtgtctttgctgaaataagaagcataggtacatagacatcccatgcccagactaagcgaaaagaatgcctgtcccatagctcccagaaacacgttaccgtccactttgctgaaatccggtttcagtagaaattcgatgcctctgcttgctccgggtaaagtgacggaacatcccaccaatacaagaataatgatgaaaagggtcggcatcataattttggatgacttttcgatacccttctccactccttttacaatgatgaagtgggtagcgagtaaaaacagagtgagccacaaggccggacgccagggattgctggagaagttttggaaagaagagatgaactctgccggagttttacctgcaaaactattgctgacagcctcaaatatatactctaatgtccatcctgctactacggagtaatagccaagaataaggaatcctgccaaaactcccattcgccctacccaacgccattgagtgcccggagccagtatctggtaggcacgggcggtgttggcttgtgagtgtcgtccgattaagaattcggctatcataataggtaaccccagtagaaggatacatcccaggtaaataaggataaaagctgctcctccatgattacctgtttcataagggaatctccatatattacccagcccgacagctgaacctgcagaagccagtatcacacctaatttactaccaaaattacctctgtctttttttgtcatagaaagcgtatgttatcttacaattcgatagattttattgttttaaacgtgcaaatatagaaaatgttccttatatttgcgactcatctgtaatttatttaggtatgctatcttatattaagaaatatcccgtatcgctctttattattcttgcggtcatctatttatcgttctttaaacctccttcaacggagatcagtaaaattcctaatatcgataagattgttcatatttgtatgtacttcggcatgtccggtatgttgtggctggagtttttgcgggcacaccgtagagatcataccccgatatggcatgcatgggtaggagctttcgtttgtcctgtattattcagtggatgtgtagaattgctacaggaatattgcactacttatcgcggaggagattggttggactttgccgccaataccacaggagcggtattggccagtctgatagggtattttgtagttcgtccacggatggtagccccaaagtaacttattataggaactctacgaccgtacttagcttaatgccatttgagcctttaatcaggatggtgtagccttggggtttttccgtttgcaagtcctttattaattcctgtgcgttagcatatgtaggatagggaggattggttgatgcaaataattctcctaccagcaggactttttcaaacgaacactcttgcaggtattctacaattttatggtgttcggctgcgctttctgctcctaactcgcgcatatcacctaatatcagcattttccgttccacagtcatgttacggaagttctgcagagcggccatcatactggtcggattggcattgtaagcatctataatcagtgtattatccgcggtcttttttagttgcgaacggttgttgcggggagtatatccggccaaagcttcatctatctttgaggattctactccaaagaatcgtccgatcgtgacggcagccaatgcattcggaaagttatattcaccgataagttgagtttgtacctgatgtaaatttccatctttgcctgctttccattcgaaagtcaggtaaggagaattaccggttacgtggccgttgacgtacagcgaattttcacttccgtaaggaatcaggttcagcccctgtgcgatgtccatcagataaacattatcatggtggatgaatacggtagaatcatccttctcacggaggtagtcatataattccccttttgtccgaatcactccttcgaatgaaccgaaaccctctaaatgggccttacccacgttggtgatgattccataatccggttcagcaatatgtaccagaaacttaatctctcccggatggttagcccccatctcgatcactgccaggtcgtgttccgcctttaggcgaagcaaggtcatcggtacaccaatgtggttgttcaggttaccttccgtgtaaagcacattgtgggctttcgccagaacagcagaaatcaattctttagtcgtcgtcttaccgttggttccggtgataccgatcaccttcgtacccaactgccggcgatggtaattggcaagttgttgcagggtttgcagacagttgtccacaagtatgatgtgtttattatcttccggagcatattccgcttcatccaccacagcataggcacaaccgtccttcaaagcctgggcggcaaaagcatttccgttgaacgattcgcctttcaaggcaataaacagtgaaccttcagggcagttacggctgtcggtggtcactacggcacaatccaggaatatctggtagagagcagaaagtttcataataatccgtttttacggagggtgttgcaaaagctcatcacagactttagtaacaccctcttctgttgttgctgcaaaattacattttctatttcagattatcattaaacaggaacgaatttcgtttggtataagaaatgacgagcatcacaatgctgatacataaattgaatacaaaagcaaactgttgggatttgatatgaaacacggtcgactggaagaaatcgataatgaaagggcacaacaggatggcgaggtaattcatcgccatcacaaatgccaatgccaatgtcactttgcgggggattgccgtgtgggttgtctgattgtagacaacaggttgaatgactccgtatcccaatcctaccaagatacatcccggagctatcatccattctttgggtgagatccagatcagtgccagcccgatgccgatactgaggaagctgtagaatttagttttctccttcagtgtaccaacgatgcgacttaaaaagaagccgggagccatgatggccagaaaaaagagtgagatcataatgccggagttaccgctggtgaaatgatattcttccatcaggaacggcaggttgaaactgactaccagtaccaggaaagtggcaagcccgtaaacagacatgattcctgcaagatggcggatatgaatgccgtatttactgtttcccgtatctacatcctcctcttggcttgccgtatctttatcattggtaagtgaggtgcttccttcgcttgccatgctgcgttgcagatatactgacaggataagtgagacaatcggcaacaggtagaccacaaatggcagatgccagttgacttcagccagatatccggtgaccaccgtagctatcacaagggttatattcgtaatggcggaacttaatccgaactgtttcacacgatatgaaccggtgaagtattttgagatcaggccggtggacaacggaacgatcagccccgatcctactcccagtaaagcacttacagcaatcagttgccacatttgtcccgaaagtagataaagtattccgcttaaggcaaagatggcaagcccggcttgtaatagatgtatgaaattgacccgttcggtcagtttgcccgccagaaggataaatgggataatcagtagtgagggcagagacgaaagcatctgtatgtccagttcggtggagtgtggaaagatgacggatagcttccccaaaataggagaaaccgccagaccgggtagggcattcagggccgagatagaccagatgccgataagggtgataaggggtatagtcccttggccagtttgaatacgcatagttgtataggtattataaagtttaggtgtgtgaagaacaaacgattcgtcagaatgttcggcatctaagcagcagaaagtgtgttgggatatcttcctgcaggattgaagataacttattaacttttccgtctccctccctttttaataaacgccaaataatgtaaaaccgaagaactttcatatcctttcgatgttgttgtgggaaattcgacggggaaaatccccatcgcctaaacctaattaaaaataagagtaattatggaagatttaaatttcagaaaaggtgatgctaaaaccgatgtatttggttcaaacaaaatgttgcaaccctctccggtggagaaaatacctgatggacctacgactccggaaatcgcctaccagatggtgaaggacgaaacttttgctcaaactcagccccgtctgaatcttgctacattcgtgactacttatatggatgactatgcaacgaagctgatgaatgaagctatcaatatcaactatattgacgagacagaatacccgcgtattgccgtaatgaatggtaaatgtatcaacattgtagccaacttgtggaattctccggagaaagatacctggaagacaggtgcgctggctatcggttcttcagaagcctgtatgttgggtggtgttgcagcttggctgcgttggcgtaaaaaacgtcaggcacagggcaaaccgtttgacaaaccaaactttgtgatttcaaccggcttccaggtagtttgggagaaatttgcgcagttatggcaaattgagatgcgtcaggttcctctgacattggacaagaccacactcgatccggaagaagccttgaagatgtgtgatgaaaatacaatttgtgtagttcctatccagggtgttacatggacaggcctgaatgacgacgttgaagcgcttgacaaagccctcgatgcttataacgccaagaccggttatgacattcctatccacgtagacgctgccagcggtggttttatccttccgttcctgtatccggaaaccaagtgggacttccgcctgaaatgggtactctctatcagtgtatccggtcataagttcggtcttgtatatccgggtttaggttgggttgtctggaaaggtaaagaatatctgcccgaagaaatggctttcagcgtaaactatttaggagctaacattactcaggtaggtttgaacttctcacgtccggctgctcagattctgggacagtattatcaattcatccgtttaggattccagggttacaaggaagtacagtataactctctgcaaatagctaaatatatccacagccagatcgctaagatggctccgtttgtcaactactctgaagatgtagtgaacccgttgtttatctggtacatgaaaccggaatatgcaaagaacgccaaatggactctttatgatttgcaggataaactggctcagcacggctggatggttccggcatatacactgccttctaaactggagaattatgtggttatgcgtgtggtagttcgtcagggattcagccgggacatggccgatatgctgttgggagatatcaagaatgctattaccgaacttgaaaaactggaatacccgacaaccacccgtatcgcccaagaaaagaatctgccggtagaaaccaaagtgtttaaccataccggtaaaccgcaagttgctaagaaataaataacattattggtatggacaaaaaaatatctatttcccaaataaaagaggtagtacaacaggcctatgagcaagtcaagggtaataccggtggtaagaatgccgattatattccctatcttgctaatattgacaagaacctttttggtatcagtgtctgtttgctgaatggtcaaactattaccgtaggggattttgactatcgtttcggtatcgaatccgtatctaaagtacatacagccattctgattctccgtcaatacggggcgcagaaggtgttggaaatgattggagcggatgctaccggactgcctttcaactctatcatcgccatcttattggaaaatgatcatccgtctactccgttggtcaatgccggagccatctctgcttgttccatggtgacgccggttggtaattccgataagaagtgggatgcgattgtacagaatattaccgatctttgcggctctgctccacagctgattgaagaactctataagtcggaaacagctaccaacttcaacaaccgttccattgcctggctgctgaagaattataaccgtatctatgatgatccgaatatgtcgctcgacctctatacccgtcagtgctctttgggagttactgcacagatgttgtcggtggctgccggtacggttgccaatggtggtgtgaatcctgttaccaagaagcaggtgttcgatgccgaactgactcctaaaatcacttctatgattgccaccgtaggtttctacgaacattcgggtgactggatgtatacttccggtattcctgccaagaccggtgtaggtggtggtgtgatgggggtattgccgggcgtattcggtatttctgcctttgcacctcctttggatggttcgggcaactcagtgaaagcacagttggccattaaatacatcatgaacaagttggggttgaatgtattcaatggtgcaagagtaaccattgttgagtagtagcggtaacgctttaccgtttttttgtttaggttgctccgagggcggtttccgcctgaggggcaacctttttcttttcacacattggcccggatcaaaggaagggtgaagataaaacggcatcctcctgtatattccttatctatgatgaggctgccacctaacttttctgcgataatacggcatatagggagtcccagtccggtaccttgagaaaagtcgttcagtttggcaaaacgctcgaatacatattcctgttgttctgcaggaatgccttttcccgtatcggtaacggtgtatatgatccggcttggactttccgctatagtgtaggccagaataatgcttcctctatccgtaaatttagctgcgttgtgtagcaaatgggtcagtacttgcgctactcttgccggattagtcaatatggtgagccgtctgcattgtggctcaaagtaaaggctgacccccggtttcacagaatctcttgaccgctcgatacttgtctggcagcaattgttgatgtcgtcgggtttattgtatggcaattcttccgactgatcaagatacgaaatgtcgagtacgtcactcacaagccgcaataagttagtgctgcttgtctctatgatagaggcatactcttttgtttcatcttcgtttttaaagtaagcactcagtacttgcgagaatcctacaatcgcattcaacggcgtacgtatttcgtgtgacatactttggatgaatgttgttttcatctggcttgcagtttccgcacgttctttggctttgcgcagctcctcaccgttttctgtcaattccttgttctgttgtaccacaattgcttccgacttctttaatttctgattcagtttagaaatgcggcagaacatcattgctactactaacaggacgacaacgagtgagatcaggattgtataaatagtctgtagcttttcctcttgcatgtgaagcagcaaatcgcttttttctttctgtaactgttctacctccaggatggcgtagaactcactggtagagttctgtatttcctgggtgcgtatcgaatctgtagccaggatgtaatcccggtaaaattgggccgcccgtgctctgtcgttcattgcccagtaaatatttccttctttttgagtgatgctgtagttcaagtatttgtttgaagagagggagtcagctttgatccggtcgatcacttcgagcgctttattatattctccggtagccaggtaatactcagtctgtacatagtataatccgtttctgtagatggtaagtgttttgtcctcttcgaatagttgttccatcttccgaagtattttcttcgctttatcgtattctttcgtttcgatgtagtacagaatgtaagccttgtttattgtaaaattctgataggcactttttatctttttgcttccttcgtccagcgcttttttggcatcctcaggttggtgcaattcaagggcacactgggcaagcgatgcgtattgggtaggcaggttgatgtcttctattccgttttgctcgataagctctatttgttttttgaaattctcatatgccagtttgggattcgactgagtcatataaatggttcccaatgcccgataacactgtacgattccggggatgaaattatcagcttcggccgaccggagcattttttgcgcctcataaatggccgtactggtttgatgttgctttatgtaataagtaatcagccggcttccccaggcaaaatagaagtatttcaactgcccgttctgtttgcttatctttttcacgttctctacttcaatcagaatgctgtcgagatcatttttataataataatagtccagcttcagcgaagcggcaacagcttccatgtgtctgtcctttttctgttttgacaggcgggcaagggtatcgtttatttgcaggaaagccggactgttgatttctgccttacattttaagaagtagctacgcaaaacgctgtccgtctttgtaagcgtgtgttcagctcttgtctgatattgaaagcagaacaaaaccagtataggtaatatgatgtgacggcataatttgataaacattgtttcagtagtcttgatacctgcaaagataactttatttttagtgtgcagatagcatagggacatttatttttctttatctttgcgacaatcaactgtaaaaacagaaaatggattcaacgattctcaaaagtctgaatgtaaacggacgtttactcgatctttccactccgcaggtcatgggaatactcaacgtcacgcccgattctttttatgcaggcagccgtagccggactgaagccgagatcgctgcgcgtgcatgtcagatattggatgaaggtgcatcaattattgatatcggtgcttattcgtcacgtcccaatgccgagcatatctcaccggaagaagagatgcaaaggctgcgtaccgggctggaaatattgaaccgtaatcacccggatgctattatttccgtggatacattccgtgccgaagtggcgcggcagtgtgtcgaggagtatggagccgccattatcaacgatatttcggcgggtgagatggacgagcagatgttcccaaccgtagcccgtctgaacgttccctacatcatgatgcatatgcagggcactccccagaacatgcagaaggaaccccactatgaaaacttgttgaaagaggtttttatgtattttgcacggaaagtccggcagttgcgtgatttggggatgaaagatattattcttgatcccggtttcggttttggcaaaacactggagcataattacgaactgatggcacatctggaggagttcggtatcttcgaattgcctttgttggtaggagtctcgcgcaaatcgatgatttatcgcttgttcggagctactccgcaagaggcactcaacgggacgactgtgctcgatacggtggcattgatgaagggagccgatatactacgtgtccatgatgtacgtgaagcagtggaggcggtccggttgattgaaaaactgaaaagcgtatcgtttcattcctgatatccgaatatttaactcttaatattttaatccgtgttttttgaatttggcataaaagattttattgatatcctgttggtggctttcctgctttactatacatacaagctgatgaaagcctccggatctatcaatgtgtttaccggtattctggtgtttatccttatctggctggttgtttcgcaagtgctcgagatgaaactcctcggttctattttcgataagttggtaagcgtgggagtattggcactgatcgttttgtttcaggatgagatcaggcgtttccttctcacgctcggttcgcatcaacatgccagtgccttggtacgtttccttaccggaaataaaaaagaaaaacttcagcatgatgatatcatgcccatcgtgatggcctgtatcagtatgggaaagcagaaggtgggggccttgatcgtgatggaacgtaatgtccctcttgacgatgtcattcgtaccggtgagattatcgatgccaatatcaaccagcgcctgatagagaatattttctttaagaacagtcctttgcatgacggtgcaatggtaatcagtaagaagcgtatcaaagctgccggatgtattcttcctgtgtcacataatttggatatacccaaagaactgggactccgtcatcgggcagcaatgggcatatctcaagtctcggatgctttagccattatcgtttccgaagaaaccggagcaatttctgtagcatggcgcggacagttctatcttcgccagagtgctgaagaacttgaaagtctgctgacaaaggaaagctaaatatcacgctctcatacaaaaaatgcatttcgatcttccatcttccaccttttaagaattttggttctgataaacagactcttagcgggtggaagatgctgtttttaagggcttttatcttccacccctatcttccatcttccacccttcattttagtaaaggaaataagcgtaatctatttatatatagcatgatgggtgggctgttctttctgcttatacctataaaagcattttgttttccttagtatctttagcgaaaatggtctgaatcttatctgggcccgcatgtctgtgcccatgagcccgggtacatgggcccatgagccccggtatgcgggcccatgagccccggtatgcgggcccatgagcccacgtatgcgggccggagtaaagatcgtatgaaaaatggtaattatcttgttcataaaggtttatgatatgggggaaatcaagttggtctcttccttatttgtgcagggggaaaggtctttgggaaattgtgtgaagagtaatgaatcaatagtgtatttgcatgtagctcagttggataatgccggactgttattgataagatttatagatgaaactggaggtagaaaaattatattttatttgcaatcaactctttttttgattttctttgcaaaagaaaatgatgaacaatgaaatttatctatagtatcttatttgctttactttggataggggttacaattacttttggatcctatctttatcgtatgggtctgcctattgtaaatgcaagtgcacaaaaactcttgttgcgtacaattgatgaagacttggaatgtagattccgaaaattgaaacccaatcaggcgtacgttaccggaaagaaacatacaaagaataagaaagtaacccttacagataagagcgggactcacaatgtacgtcaatttgccattgatactgtttatacggatacatcttttgtgcagagagttaaacaatcttaccttatagagcgaaaccctattcatgtagattctctgaatcagaaatggcagttgaaacttcgtatggatggaatctgtgctaagaccggaataaaactaacaaattctctaaagaacggagagcggatatcggcatcgagtgggctaaatgaacccgattgttttttattagcctatagtacaggggtcggttatggtataaaaatggatgcttttataagacctttttgggcgagcgttattttaaaagcgcattggaataatatctggacttggagctatgttcttttttcactgatcttttgtttgttttatgttccgggtgttcgtctttttcttgttcaggttttatctaagttcagaatagtagataatcatgttaaatcgccgcaaccgcttgttcaacaaaaaagtgaatttgtttgggaagtcaatggacttacatttgattatctggagaggagtatcacttatcgtaaacagacttgtatactccgaaaacaagttgctgaggtattgctggcatttcttaaagcacccggccatttgctgttgaatgaagatttgaaaaaactattctggaaagaattagaggatgtagattcttgtatggaacgcaggaaccgactgattactgatttacgtactgatttaaggaaaataggggctaatcttggtgttactttggtaaatggaggctatcaactccactttcgttcagaaaatagtaagaaatcagtgaaaaatcagtgagaaatcagtctttctcactggcggtgggcgggataagccatacctttgcaaaaaaaacatagagtatgaaaaacgcaaaaattactattgggcttatcgggctattgctaataggtcttgtttctgtgagaaaagaaggaaaggtacaagaagccggtttactattgcaaaatgtggaggctttggctacaggagagtcgttccccgatggagatatagcctgtatcggtgacggatctgtggactgtccgttcacatatctgaaagttgaagtagtataccgtgaagaataatgggccgtcccattaaaattatcggctatttatgctttctgatggcactttgctcatgtaaagagaccaaagagcagcaaatatcccgtttgattcacgaatgggagggtagaacgattgtctatcccgctgatatgacattcagtgttttgggaaaggacagtgccggttattcgtttccccaaaatgaatataccataatgacttacgtggattcggtgggctgcaccagttgcaaattgcaacttcctacatggaaatatttcatttctatggtcgatacaatggccaatggaaaggtatcttttctctttgctttccatccgaaaaacaaaaaagaaatctcttttctattgaagagagatcgattcctttatccggtttttatcgatgaaaagggaggttttgatgctttgaatcatttcccttcggatgtgaactttcaaactttccttttggacagtcagaacaaggtgcttgcgattggtaatcctgtccataataaaaaggtgcgtgacctttatttgcaaattattaccggacagcaaaccggagtcgctacctcttcccaaacaaaagtggttttggataaaaacctcgatgaaatgggcgattttgattggaaaactccccgaaccgctacttttagtttgcggaatcttggcaatcatcttctgattatcgaggacataaatgcttcgtgtggctgtacatctgttgcatacagcaaggagcctgtgtctccggggaagtctgccgatattcaggttacttaccgtgcagagcatcccgaacattttgagaagaccattactgtatattgtaatactcccacctctccaatacgtttgaagattcggggtaatgcagttgataaagaaaactaatagttaaccttaaaaaattatggagaacgttagcctatggaaaaagtttgatttagaaggcaatttgattgcttttccgtggaaatgataaacggaataaataaaatgataatcaactaaagtaagaaaataaaatgaagacgaaagttaaagtaatgattgcgttcatcgcagtggtgatggtatcattcactggttataatgtgtatcaatcacagaaaaataaacagttatcgaatatagctatggcaaatgtagaagcattggctagtggggaagctgttgagattccttgccattataagaaagattcatactgtgagtatgaaattgtaggttctgatggatctacaggtacctcaagaatttctgatgcagaaaaagacaattaacaatttagctcttttgaaatctgaagtatctatatttagatactcttatttcaaaggagctctttgatataatattttatgagacgattttattccttgattttgatcctggcttttttgtattcttgtagtgtgggcgggactaaagaagtaggtgatgatgtgttggaagtatcattgacaggtactcctttacaagagaaaactatgatggtaaccggtaccttcgttgctttatggaatgatacattggtacttagatcctcagatccggatgctttattgaatttgtatacaataaaaggggatagtttgcttaggaagtgtggctttctgaatcgtggaaacggccctaaagagatgaatatgtttagtttctggactgataactctgccagaaagctcacgttgttgaatatggacgggagtttgggatatgggcttgagatgaattttagcaatccggatagctgtttgcgtcaagataattggagacgattggatttacgtaaaatcactaattttcgatcaggaagtgggtttgtatgtttaccggatgatcggatattgatggtaggcggggtttataatactcccgttatattgtcggaaatcaatgttgaggggcaggttgctgttcctattaatttttggccggaagatgggttcactgaaagattccaacctaaacaggctatatatatggggaatgcttctttatttcggaatatgaaaacgaatcaattattatatacttgtggaaaagggaagtacgcttttatttttaagatagaaaacggaaagtttgttcaagagaaaattttgtttgatagatttccttcttatgtaatgtctaaggacggaatgaactatactttagatgcaaattgtgaacctggctttaaagtggttgtaactgatagcttgatatacatgcgacctgaagaatataaaatagagaagggtacaacgccaaaggaatataaaggttatccatattattataatgataaaatttatgtgtttaattgggaaggaataatggtgaaaaagtatattcttgatactccgttccatgattttatagttgataagaataatcagataatgtatgttagtacggagagtcaagaaaatggagagactattataaaaagatataatttataagtgcaatcgtgaatatggttgatacaatacaaaccgctacttttagtttgcggaatcttggcaatcatcttctgattatcgaggacataaatgtttcgtgtggctgtacatctgttgcttacagcaaggagcctgtgtctccggggaagtctgccgatattcaggttacttaccgtgcagagcatcccgaacattttgagaagaccattactgtatattgtaatactcccacctctccaatacgtttgaagattcggggtaatgcggttgataaagaaaactaatagttaaccttaaagaattatggagaacgttagcctatggaaaaagtttgatttagaaggcaatttgattgcttttccgtggaaatgataaacggaataaataaaatgataataaactaaagtaagaaaatacaatgaaaataaaaaagagaattttgactgtgcttgcaatttatgcggtattatttgcaggttataatgtatataaatcacagaacatccgtttgtcttcagatatttctttagctaatgctgaggcattggcgtttggtgagtttgatgagttagattgcacaagttatttaggtgtttatcaaggtgcctcttcttcttctggtaatacttatattcataaatatcgttgtggaggaactgggacagagtgtcatgcgagggatgagatccattcttattatcaaggaaagttatcaataacagtacaaaatgtagcaggcatttgtaggtaagtagagatgatcttttaaacaataatgcgaataagtagttggtttactgattcagaaagatagacataggttgcctgattttagatacgatacaacttgtgagaacaagtccctgtggctttctctttctttatggcttgtacttctgccttaatctcttatgtggtgtaaatatttgtactggaaagttttcatcaaagaaagaaaaattattatgtgtcttatttttcaagtctgttttttacttaactatcctgcacattctcttttgaatacggtcggggcattttctgaagcagctgttagaataatcattccgggaaagtaatggttctttcctgattctttcttttgtaggtgataattggtaggagaccaaggattgagaggaccacaatcttctgacttgaataattgtatcgtgatttctgacgaagttttaaatgcttctgaaagtatgtttaaatgatgtgtgttgaatgtttcttgtaagaaaacaactggcgttatttttcttatttgttggtttttaagtaggctcaaaacagtgggttgataaactgagtaataacattttgaatcatggattagaggtaaataactcctaattcgcattgatagtctaattattagcttatgaagacagtattatttttaattataggcttttgtctattctcttgtataaacaaaggagggatggcgggagacaaagctatctgtttggattctatcgttatacaaaaggaacttcgattctcaagtctttttgaaaaaccggaaattattattttggatgatgataccattgttggcaatattgacaaactgttggcaaaggactctttgcttcttattttagataaagaattgaatactctccacgtatttgaccgaagcggagaatttaagtataatatcggaagccaggggagtggtccgggagagtatacgttgctgtgtgattttacccttgataaggaagggaatgtctatgccttagattttaccaggcagattgtgtattgttattctttatccggtcagtttttcggctctttatcgttgaatcgtgatgaaggtcaaagccattatatacactataatcaggatgatttatacacagatttacattcaaaatcgggtgaagacgccatgatgaggaaagttgatttgaagggggggcaaacagaaagaaaatatttttctgtaaatgttaataatgaaggatggaggcagattcaagggcattctcctttctgtttacctttggaaaaggaattatgcttttctcctttgtattcaaaggatatattatgtttacagggtgaccgggaagatatctggctgaaatttgtaacggacgcttggatggataaaaagacacttgataaaatagatgtgaataaaggagaaactcttcggtatttagtagaatccggtaaggtacatagcttgatatttttggctcatgtgaaaaatgattatctttttaagtatcagaaaggttatcaaacttattatggtttattgagtgcgtctcgggactcttgttctatattcaatgggtgtgttgatgattgggtgtacagggcgaagggggacgatgtacatatcattcctaatttgataacttatgacgagaagggagtgtatggctgtcttgatatgtacactatgcctttgtttttgtcgttagtgagatcggggcaagtgaatgagagtttggataggattttagaactgaagaatttgacagagaattctaatccattgatattttattatcctgcaaaagaataaatatcttagaaataataattatgaaaagaaaaaaggatcttttgattggagattgaatctttaaatattatcttggcgtttgttataggatttatctttttgcaatggtaagataatgacttctaactaaataaacaaaaagaactatccggtttttgcaacagcattttgtgaaaaaaaataataatattgaaccatgatcaaacgaccgtacttaagcgtcaccctacttctgttgtcatctatgtgtatcttgggggcatgcgaaaaagagaaatcccatacagttctggaattgttttctgaatcccaatctctgtctcaaaagaaggacttttatgttaatgaagattctatagcaataatagagggattaagttgtgacggaaagaatctcatagttaatgactatcactcgggatgttgctatacgctgtttgacaaaaaatcaggtgaatatatcgctcgttttgggactatcggacagggaccggctgagttgccttcaccctgttatggttacttaacggaaagcggtttcactgtttttgatgaccaaacacgcattgtgatgaaatacagtcttgactctttacgcaacagtcgcaagaaggatggttcaccggtacgtctggcgcaatataaaattccggaggcacagatttcaaggctcatagcgatagacgatacgacttttttgtgtgccgggacatataaatcccgttaccaatatctgttattcaacaaaaatgacagtgtgctggattacggtgtggatgtgtataatgctgcggatagcgcttttcaaacatacaccagatatctttctaatcaaggaaatttagtaatgaaccctgagaaacatacatttgccggttcaattaacttctcgtccaacatggacttttttgaaatagtaaacaataaaattgagttgataaaatcgttgaggttgggagatccaatcaacaaacccgttaatgaagaaggtatttattatgtcgatctaacagaaaatactcagacgggttatatagatcttagcgctacctctaagtatgtttatgctttgtactctgataaaaaaatgtacgaaaacaaccgaaaatcagataccgtattggtttttgactgggagggtaatccgattaagaaatattcgttagatactgatgcttattatattgcagtggatggtactcaacagagtttgtttgctgctgtgaaaaatagttcaagtggatggaaaatagtatgttatgcgttagattaatgattcatattatatatggatttagtctgcctgccgatacatttccatttgttttcacagatagtgaagaaagtatttcttttatcgtttcatgtgtggcgaaagaatggatttacatttggtagcctgcagaggagtatcacttatcgtaatcagactcgtatactccgaaaccaagttgctgaggtattgctggcatttcttaaagcacccggccatttgctgttgaatgaagatctgaaaaaactattctgaaaagaattggataatgtcgattcttttatggaacgcaggaaccgactgataactgatttatgtaccgatttaaggaaaataggggctaatcttggtgttactttggtaaatggaggctatcaactccactttcgttcagaaaatagtaagaaatcagtgaaaaatcagtgagaaatcagtctttctcactggcggtgggcgagataagccatacctttgcaataaaaacatagagtatgaaaaacgcaaaaattactattggacttatcgggctattgctaataggtcttgtttctgtgagaaaagaaggaaaggtacaagaagccggtttactattgcaaaatgtggaggctttggctacaggagagtcgttcccggatggagaaatagcctgtttcggtgacggatctgtggactgtccgttcacatatctgaaagttgaggtagtataccgtgaagaataatgggacggcccattaaacttatcggctacttatgctttctgatggcactttgctcatgtaaagagaccaaagagcagcaaatatcccgtttgattcacgaatgggaaggtagaacgattgtctatcccgctgatatgacattcaatgttttgggaaagaacagtgccgactattcgtttcctcaaaataaatataccataatgacttacgtggattcggtgggttgcaccagttgtaaattgcaacttcctacatggaaacgtctaatttctatggtcgacactgtagccgctgggaaagtttcttttctctttgctttccatccgaaaaacaaaaaagaaatctcttttctattgaagagagatcgattcctttatccggtttttatcgatgaaaagggaggttttgatgctttgaatcatttcccttcggatgtgaactttcaaactttccttttggacagtcagaacaaggtgcttgcgattggtaatcctgtccataataaaaaggtgcgtgacctttatttgcaaattattaccggacagcaaaccggagtcgctacctcttcccaaacaaaagtggttttggataaaaacctcgatgaaatgggcgattttgattggaaaattcctcagaccgctacttttagtttgcggaatcttggcgatcatcttctgattatcgaggacataaatgcttcgtgtggctgtacatccgtcacttacagtaaggagcctgtatctccggggaagtctgccgatattcaggttacttaccgtgcagaacatcccgaacattttgagaagaccattactgtatattgtaatactcccacctctccaatacgtttgaagattcggggtaatgcggttgataaagaaaactaatagttaaccttaaaaaaatatggagaacgttagcctatggaaaaagtttgatttagaaggcaatttgattgcttttccgtggaaatgataaacggaataaataaaatgataatgaattaaagtaagaaaatacaatgagaaacaagaaaaattatgtatttgctgccattttactttttgtatcactgggagctagtctgtcttatgttatctctgaaaatgaaataacggatgtattaacgttggagaatgttgaagctatcgcggcaggtgaaactgattcggaagggcgtcttccctgctattcttcttttatcggaaaaaattcaggtgaaaaaacggtgaaggattgtggcgattgtatggatgtagattgtgttgattgctccgataaaggaaaatgtaagaaatgatgtttgattagccttagctcaaagacatgtgctagaagagttattgatattagcttttgctcatatgcctttgagctggttctttaaaatttagatcatatttagactgttttatgtctttcttatttgttgattttatataggtgaaaaacttttgtaaataagtagaggttaatgaaaaatatttatcatatgattgtaattttcttattgataagttgcaatagaattccacaaaaagaaataaacgttgttgatatacctatccaacaagcaagattttatattaacaatatagattccactaaaatattgaatcctggtggtatatattgttataaaaatcatgtaatccttattgagcgaaaaaataatcctgctttttcattttggacatcggatagcctacgctatgaattttctgagggattcattggaggaggtcctaatgagttcatacgtcctcggagcaattatttcgctgtatctgattctagtttctttattcttgattccaatatagaatgggaagtccaattagaagaacagcgtatacaggtcattaataaggagcccataattattccggatgccattaatcaaatggttcatttggataatggtaaatatattatggcaggaaatactgatggtaataataatgcagagcattttttgtatgatataaaaacaggagaatatacattgtttggagaatatccatttacagatttgtttgatgaaaggaaattttttttcaattttaaatatactgctggtatagcagggaaaccttatgtttgggatttttatgagaactataatttacttcgtaaatatagtatagaggggatactgttacaagaagttcgtttagttggtgttgcagaacgacacaatgatgattctaaatctcacgaattacagaatcgcccatattggcgaattgttcaagcaacatctcggtacatttacgctttattctatacaggagaaactgataaaactatttataccggaggagctattccagagttgcaagtatgggattgggatggaaatttgacaaggcgtatattgtttgataaaaaatataatcaaataactgtctctgagaccggtatattgtatgcgattaatacagtagatacatttaataatcaaatttattcatatgagatgtaagactgagtgttttttctattttttctttgttttgttgtttgcagtttgttcttgtagtaacaaggcaaatacaactgactacgtgaaaaatttaaggggtcaaaaagtttggtttgaagaaagtgtgacagatacgttgaaagaatctaaaatattgatattgatgcccgataccggtgattgtacaacttgtacaatgcaagtttatgattggtatatatataaattagatttggataagcatgaattaaattgcgatattatttatgtcttgaatgattctgttagattagataagtctattgcgaatttaatgaaacgctataagttaaattatattgcgaatttatcttctttttattctgagaataagatactaaaagatgtccccttcacaacctttttaatagataaggctaacaaaataaaattagtcggttctccaatagataatgataaattgtggaagttgtataaacaggctttgcaaaaataaagaaattcgatataattttagaatgatcttaactgcccgtcattgataaagtctcgatcaattgagacttttcaaagaaacaatgttacacaatagaaagaaacatgcgtcttaactatgaaatatatactgtttatcctgttagttttaactttggcagcttgtcaatctgagagagagaagtggttggaatatgctttgggatttgccggtgataatcgcgtggagcttgaaaaggtattagaacattatagagctgatccggaaaaattggaggcagctcgttttttaattcgtaatatgccgagatggtattcttatgaagggaatgaactcgattctattcatcatttattagttggggtttgtgaagggcgttctatatctaaaagggagaagaataaatggaacagaatttcctttgactctctctccaagatatatgacgcccaagtgataacagcggaatatttgatagataatatagatctggcttttgaagtttggaggaaatatccttggaatagaaatttgccgttcgatgatttttgcgaactgatattaccttacagaatagccgatgaacctttatcggattggcgtaaattgtattatgaagattatggaactctactcgattctctttataaggggagtgatgttattgaagcttctaagatcattgacgggaaactgagaaagctgtattacatctacaatactgattttcgggtacctcacttgaatgctgtttttctttatcataatcggattggttattgtcgtgaagcatgcgacctgacaatatatgctatgcgtgcttgtggaattcctgttgcgaccgactattttgtttattcacccgattatcaacattatcattgttggacgatgttgcgtgacacaacaggaacttttcttcaattcggatttaatgagtttgaagcgtcacgtgataccttacggcatgacggaaggaaaaaggggaaggtgtatcgctattgttttggcgtacaacctgagaaaatctccgggatttcgggcaataaacggttgtatcctgtgtttagaaatagatttgtgaaagatgtgacatctgaatattttggaagtaatgatacgacaataccgatacaaatacctggagagcaatacatctacttagggatatttagtcccggcggatggattcctgtagatatggcacttggtaatgcaggtaaggttactttccgggatatagaacccgatgtgatttatcagactctttatcagggagatggaggaaaactttatccggcgggatatccgttcatatctaaaaggggaggtgagtttgttttgctgaaacccaatatcgatttgatggaggaagctatattaaggcggaaaatgcctcagcaaaagacaattgcggaatgggcttatcgagcagttataggggcaaagattgaagctgccagtgatttgtcatttatacatgcagatctgttatggcaatttgaggatacgcttaccactaattattgcatattaactccgccttcaagaaagaagcataggtatgtgcggtatgttgctccggcagggaaaagaatggagttggcggaactggcactatttaaggattcactgtgtcaggagaagattcggttgaggaggataaacagtatagaaccgattgcaaaattagagtatgttacagatggcaatatattgacttattttcaggcacgtgatacatcttcttatctggcctatgatctgggagaaagtatgccgattgaaagaattgttttctctccgcgtaacgatgataattacatttggcccggggataattatgagttattctatcaagacggaatcaatggatggaagtcattaggcaggaaagtggcgacggaaagaaaaattgaatttttagttccgcagaatgccttattgtggttgagaaactgtaccaaaggacgggaagaacaggtttttatctataaaaatggaaggcaaacttttacgtttgatttataaaagttgggtgtgcgatggtgtatgaggaggttgtttccggaaaaggaaatatgagataattgatgttttattagctatattccccaggactgaaaggtttagttcatcatcagactcatatacggttgcatctcgcacagtattttttctgatagttcaccgatggtcattcgggtgtgtgctcccggtaagcggacctcactggtcatgcactttccattgcaaagataataatatccgttattggctgacaattgttcatcggtcagttcaatgttcatttctatttccggatgactggctgcatagagctgaagaactgtccgggcatcaatgacacgtgccattcctaatgtttcgttgggcagggaggctacagggggaagttgaagaatgatccggtcggtgccgttccttagcccggcccggcagagcaattgtgcccggacagcttcattgtcagcaaataactcgttgatatacgaggtattatcgtgtttatagacaacagctatacccgttattcgattgtcctttcgggctacgagagcggtattttgtgtcaaggcaagatcggcaagaactactttgaaatcagtggacgtatgttgtaaacaacaggcacgttctgataatttgccgttcaaatattgataaacatcttcttggtattctgtaacttcctcaatgctgcccatttccgaatcggcaggtaattctgaaagagagaaggattggtgagagatgcggaaaaccggggcataacctgcttttgcataataaccgaacaaccagggttcagcgggaataagcgtactaaacaggacaccgttgcggagcatacgtgcaaaactttgtgacagtagttcgcgcatcacccctttgcttcgatagtcgggatgagtgcatgcgccggatatgtatgaagtaggcacggtttgaccacaaaacgtcatgggataagggagcatttggagcgcagcaatcacttcttcgccactttggatggctaagttgacttcgttgttataacgaagccggaagtagagttcgatgaatgcttcgctatcatcgaaacacaatttccataatgattttacctgttctcttatcatcagtatgctaccattttatcatttctacaggttgttctttcaaacaagccatatatttctccagaatcgtttccgggtgatatgagagcttagctttacgcaacccttctattcccaaatcttcttcacggttgatgtaaatatattgttcggggatgtggttggcaaattcgtaattgatcatggcataagctccatcaatattcgtatctgctttttccacatgtacaccgaaggtttctttattgatcggcatgccgaaagtaaaagctacaatctgaccattgacatgcaggatacctcccgttaatcctaactcttcgaaatggttgagggcatagagcaaagcacggcgctcgtttccggttccctcctgctggtcacagtcattggctttgcaccattttgcttccagttccagacattcctgaattctgtctttggtgatcggagtgtattcgtaatcagggtatgtgttgcgaaatttgttgatgtgattccgctttgactggaatttttttcccttcagtgttgcgagatcgctgcgcaaataaatgtagtcggcataatcacggtcaaccgtgaatccaaactgaccgggcatgatagcctcaaggtcttcgcgcatacacgaacagacacccagcatacaaaaaggttcgccctcctgccgggcatcctcaaccagttcgttcaataccttttcgaggtttccttcaccgacaggcatcatataagccagttcatcaccggcccaaaatttgaaaatcagaaaattgtcgactatggcaaacttggtgtgatacaagaaccgccagctgcataagtttgaaaaagataggtcgcagttgcggcggcaactattcatcgtgtaagctgtgatggtatccttatcctggatcgttatatctttgaatgcgatcataaagtttttgtttcctaattaactgtttatatataacaaagataaaacgattttgttagagaatgcctaacattcgtaaaatagttggagtcaacaatgcggtaaatataccgttgagtgttaagccaagacttgcataggctccgtatttgctactgatgtccatagccgttgaggtgccgacggcatgtgcggccgtacccatggagagtccttgagctataggactacctacgtgcatgattttcatggtcttgaaacctaatacagcacccagcagacctacacatactactacagctgctgtcagtgacggaattccccccaatgttttagtgacttccatagcaatcggagtggttaccgatttaggagcaagtgacagaattacttcctgcgaggctcccattaacttggctatcaatactactgatatcacaccgacgatacagccggccaattgggacagaatgatgggaagcagctgttttttaatggtttcaagttgcagatataaaggaactccaagtgctacgactgccggcttcagccaaaattcaatcagatgtccaccctgattgtaagtctcaaaagagatgtttgttattttgaggaagataataatgactgcaatagtcaacaggatcggatttagcaacagaattcctgtctttttctgtaaaagcttggcaaagaagtaaatcccaaaagtgattgccaacaggaaaaattcattttctaaatagttcatttgagtttacgtgttaattgatgaacccatccggtgatgacaagcaccagcagggtactgactaaggtagctatcacaatcggccagaattgcgccgcaatgatgtcgaaatacaacatcagggccactcccggggggatgaagaagaaaccaagattagcaaccagaaagtcggacattccttgcacccaatgcaatttgatccaacctaattttaaaaaaagggtgagcagcaacatcccgatgatgctggacgggagcttaattcccgtgagataaacaatcaattcacccaaagccaaacagccaaataaaatggcacactgacgtatcatactattacctattgaattttgaaaacgttgcaaagttatgaaaaatagagttagggtatcaactaatatggtacgaagattcttttttaacagtgggcaactacaaaaaaatcaagaaaaagtaaacgaaatggattactttatctatttttgcaaaatgaaaaacgaatatacataccgaatattaactactaaaaacagaattgacatgaaaaagagtttattaatcagtgtttttgcaacactggcaatgatgatttctttaaatgcatttgcacaagaaaaagcgacaggtaaggcttataaagcaattcaaaaggacgaaaaagtaatcaacaaagatttgcagaaaaaagcaattaaagaagcccgcaaagaggcgaaagcactggcaaaagaaggcttcaagactccggttggaaaattgccgttggacaaacagctggaaaattcatgggaaaaacagatggaaatcgatatgaatggcaatccatattggtatatagcaactgcaagagtgattggtggaaatcagtcggctgcggctatgcaggcaaccaatactgctaagattgacattgccggacaggttcagacaaaggtgactcaactgattgaatcgaaggttgccaatgacgatatgggacaggaagaagcggccagcctgtcgagtgctgtagctgccggaaaaagtattatcagcggaacattggggcgcactattcctttggtggaagtgtacaggacattgccaaataaaaatgttgaggtaatggttaccattggttacagtctggaggcggcaaacaaagttgctgtcaaagcgcttagcgaagaattggctaaaaaatcaccggaactggctaaagaactggataaacttgctcagtgagttttaatataaaaagcggcgatttttagaaagtataacataaaggtgattacgctctctcaatcaatagattaatgggagaatggtctgttctcgtattgaataacgacgctgcaaaaagcatacttgggtgagagtatcgttacttaaccgttacctcccgaaaggcagataaagatcggtctcaacaggttatttttcaatatcttgcgttgtttttcatatcctctgataactcaataaaaagtaactttgtaacagcaaaaaattgagtttatgaggagtacattcagagttttgttctacaccaagaaccaggccattaaaaatggccgtgtccctgtcatgggtcgtatcaccgtcaacggtacgacagcgagtttcagttgtaagcgtgacgttccccttgccctttgggatgccaagggtaactgcgccaagggtaaatccgacgaggcacggaggctgaatcaggatctggacaatatcaaggcccagatcggaaggcattaccagtacctttcagaccatgactcgcttctgacagccaagaaagtttatgaccgttataacggtttcggggacgaggtgcattcgctgatggagatttttgacagccagatagaggattataggcggcagatcggcaggaccaaggcggaaagcacctatcaggggctggtgaatgaccgtaaatgcctgctttattatctgaaggacaaattaggggtggaagacgttccgctggtgtcgctggacatggacttcatcaagggattctataactggatgttgtctgttcgggggctttccaagtccacggccttcgagcgtgtcaatacgatgaaatggctgatgtacaaggccgtggacgacggatggctcaggaagcatccgttcaagaagttcgagtgccgcccggaatacaagaaacgtcccttcctctcggaggaggatctgcagcgtctgctccgtgtcaagctgagttacaaacggcagcgtgcttttcgggatatgttcgttttcatgtgtttcagcggtctggcccatgccgatttgaaggaactgacttacaagaacatccatacggattccgatggaggtacttggctgatgggcaaccgtgtgaagacgaaagtgccttacgtggttaagctgctcccgatagccgcggaacttatcgagcggtaccgggacgtgagggagggcaaagactccccggacaaggtgtttccggctggaaaccgcaagacgatggaggacagcttgaagcgtatcggtgagaaagccggctgtagtgtccggatcagtccgcatgtcggccgccacacctatgccaccctgactcttaccaagggcatgccgctggagaccctacagagggtgctggggcataaaaacatcctttccacgcaggtttatgccgaacttatcaatcccaaagtcggtgaggataccgacagggtttgcgagaaaatcggtgacacgtaccgtcttgactgttaaaatgggaaggcgggggtgtcgaacggattgttcgacacccccgcctttgtcatgttccgggccgtctacctgccgtattgcctgtagttccggtagtttttccgcaatgtctcgtacaggacactttcaggatacagtattttccctccgatagtggtatagggtatggccccttcgtcacgcagtgtctgtaacgttctttttgagatatgcaacatttcgcacacgtcttctccttgcaggtaatgctcgtccgcgatggcgggacgtatccttgctgttgccgtttccaccgatctgccgatctttttcatccatccggtcagctccttgaactcttccgaatctttggttatgatttccgccattatttccttctttttttaatgagaccttcttccagtatttgccggatatccgtttctttgtaaaagcattttcctccaatgttcgaataagggatcacccctctgtcccgatggttctgcaggcatcttttggatatgccaagggccaggcagacttcctgggcgtccaaccacttctccggtgatgccggagccactttcctctggaaatcgcccagctgcacggaaagcatgctgagctgtcttttcagttccagatacgcgcttgtttcaataattgtaatttccataaaattatatttataaattcataacatgcacaaaataaaatgtttccatattttctcgcgacctcctcccgtaccggggcacaagaaggggggagcggcaatcacgactcccttctcccttttctttttagggagtaaaagtcaaaattgactgtcccgcctgccgatggtcttggattaatttcttatctttaccccggaaatacgaattcacccggggccgggtcaactcctgtccctgctgatatatagacataacgttccgcagaacgctcttaaaacggaaatctggcaaaatttcaatcggaatagaggcttctgcgtaaagctgtgctatgcattgtcatagcgtggtctctacgcggcaactattcaaaggttttgccagaacctccgttttgaagccacgtagggtcacgttttttttcatgaccctgccggaaccattacaaaataagaaaatggcatattcatatggcaacggttcagattctggccttcatcacccttgacggctaccttgcccgcaggtcgacattccccgacctatgggaacaccccggaaggtacggcatcacccgcatcagagagggcgccttgtcctgccttgaccctgaggtctctttcatatccctcatggaatggaaacgcgggcactccggcgtatatcttgcggaggccaccccggaaacgcttccccttgcggacagcctgctccgtttccgcatggcagacgagctggtgctgtatgtcctaccctgtttccagggggagggctcccgcctgtttgaggaaagtcccggcccttccgcatggaaactggccggaacacggaatttccgcagggatgtctgccgcctgcattacagacgggtcccgggtggataacggctatccttctgccgggttgtccctgaatgtcatctctatcctgtaattctcgtccatcctgagggatgcctcatacggtctgcccttcttgctgacgaaaggcagaaaatccgtcttctttcctttcagcaggcagagcatctgtccgtcggtcagctcccttgcgttgaacattctgaaaagcaggaacgcgcagtccggatcgccgcaccgggctaccttacggtgaagggtcagcgtttccatgccgcatttgggacagcggtggcggggcggctcgggatgctcgaaccggacctccgagagttcctccacgatctgccgcgcgtattcttcaatcttttggatgaacacgtccgcatccagatttccccgttcaatctcctgcaggtccttttcccaccgggcggtcatgtccggggcggcgatcagcttgtccttaactgtttcatacacctccagccctttgggggtcggcagcagatcgcatccccgcctctcgacataccggcgtgcgatgagcagttcgatgacaccggcccgggtggacggtgtgccgaacccacgccgttccatttcggaaagcagcgaggcttccgtaaagagcggttcgggagagtttttttcacttcggacagatatacctgttaccggcagtacttcgttttgctcccaggacgggaacacggtgttttcttctttcactgctccgtcatacacgtttctccaaccggcatgtatcatccggcgatatccggcctcgaaccggatccccccgcattcgaggcggacgttcacatcctccccggtgcagtcatcggagaaggcctccagcatcctgccggcgatcatccagtagataatctgctcgtcaagcggcagtttgccgggtacgttttccgttatgatgatggcatgatgtccggtcaccttgccgtcatcggcggcacgggtgtgcagcgccttgccttccagcgcttccgcatggcgtgcaagacgcgggttgtctttcaagagggagagcaacgccggcatgtcctccagcatgtcctcccggatatggcggcaggaggtacgcgggtatgagatgtagcctccctcatacagtctttgcaggacggatgccgtctgcccggccgtcaggcccagccgaatgttcgcctccttctgcaaggttgtcaggtcatacaggagcggcggttcctccaccgtctccttcctctccacctgtattgccactaatctccgtgatgccgcagctcggttccgggcggttacggcatcctccttccgtgcatattcttcggggctggtgagcacaagttctttcccgtccttaaggagcgacagctccagccggtaacgaggcacggcggtgaagtccctgtttttctgataacgccttgaaataagagcgagtaccggtgtctgtacccgtcccagcgaatggttccttcttccggcggccataccgagtgagatgctcgcgttgtatccgatgatccagtctgcttcccgccttgccttgcccgccagatacaagccctcatagaggctgtccggtctgaggttaaggaacgcctcacgaaccgccttgtccgtcagcgaggaaagccacaggcgttttgtttttcccttgaatcccagataatcataaaggttgcgggcgatcagctgtccctcacgggaggtgtccgtcgccgtaatcgtctcgtccgcttcccgcagcagcctgcggatgacttccaattgcttcacggcgacaggatcatcccggaagccggtttccgtccttgtctgccggacggcgagtccggacggcccgtaagcgagggggagcatttcccttgtgactggtccttctgaccgggaaaagggagaaaccggggccagcaggtggccgaacgttcatgcgacagcgtatccgtttccggtgagatacccgtcctccatcttgtcagcgcctaatacacaggccagtcttttagccacaaacggcttttcacaaatcacgactttcatttttcttacattttaattgttgcttgctttctgttttttatggactgtattgttccatgtcccttcttcgctttcccggctcctttggcgggcttttctccaatccgtggtttctttattttctcggaaagccgcggctggttttccatggtttccgcggaggaagggaatgtccggacaggaggaagtcccgtgggaaccatatcatatcccttggaggttatctccagtctcacatggtccatcggtttgagatacagggtggcttttccgtcggaggtgaactcgtaaaggactgtctcccttccaccgaggatgctcccgtagtcctggtagcaaaggctttccctcgggacgccgttctggcggagcattccgcagatctcatcgggacacaggtttccaaatttcctgtcataaggagaagcgaatatatactggtaggtggacagcagcaggctttcctggagcagactcgggcagtggtcataggtggtcatccggtatatttttctggatatgtccttcagctgccgggaaaggtcacggggcttggaggagagcggtataccgcccaagcggatcagtgagcggttgatgtcatttatgacgctcctttcccaccggcttagcaggtccgcacggttctgccggaaattgtcacggagaatccccggaagtcctctggtattgaaaaacaggctgaggcgcttccatatggaaggttccctcaggttggcggccctccaacgaatgacattgaaacggtagctttccatgaattgccggagcgggttccagtatgagaaaatgtcccttatggtcttctgcagcgccttgcggtcgatggtgcgtcttccggcatcgagcagcttctcgggggtgaatgaatctgttgtttccatttcggtttataatttgggtttcacttttggggaggccgtgtccctttgcctgcgggccggcctctttttcttttcatcggaggctggtgggaccgccttcttttcctggctttctgccatggagtgtatcctttccgcatacttgtccgtcttttggtgcgctgcgggcatctcccgacggaccccttcctttctcaggaggaattctgcgatagctctggaattttcccgaaggccgtgtatcctgtcctcataaggaaaatcccggtatagttccctctctcttgcaagtgacaggaattccttttcaataccagcgaactctttcctgtagcggaacgactcatccatatacaggtgggcgtatccccttcgggcgatatcctgcagggtcatgatctcccggttatttccggagagcgtcagggagttggtcttcacgaaacgctccaggttgtccgccgttggagacatgtcgaaagaggctgtcggaagataaccggcaagaacctccagtgggggctgtgaggcgggaaactcccgtctgtaatcctgtgacatctccagcagcctccgggaagatgtctcgatgcggtacatggaaagcgttttcaacccttcccatgcgggggaatagaagtggtccgccatgtcctgcaacaggccgcgcatatgctccggaccatacagtccgtcattgaacaccctcacaccccgttccgtcttcacaaaggtaaggcggaacagggcttttttcccttccaggagcctttccatggcggtttcataggcctcgtagttccggcaaccgggtgagcgctccatctccttgaggctggtacggtttatttcctttccctgcacctgcagatagaccgcccgtctgagcggaaccggatttccttcggtaaccccaccgcatttgagcacgtatttccaagcctcctccggtcgtttctccagcagcctctccgtcgggggaagcatcctttccggtattccgtagaaggccagcagcagattgtccggaaccaccctgttttccccctttacgtttttttgggcgacattcctgacgaactccatgaaggaatccgccccccgcggctcgtgaggggttgccatgaaggagtgtatccggttgtccggacacagttccagatagaggttcccgagtttttctcttggaggacgttcttggggatgtttcagccattccaaccatttcattgttatattcgtcttttaaaggttccatttgtttttctctgtctgtttattgtcttttcaccggcaggcggatcatatacggacttgaatccttttgttttcccggttttccttctgttctcgggctcgggtcctttcccttgtatggcgggggcgtattctcgtactttgtattccgttctcaggattctgtccgccatgtccttggaagcctgtccgagtgcccggtacatcacaatgtcgttccttttcaggcaggcctgccgccgttgatacaggctgtggaacccggccgggtggacggaaactttctccagctgtccgggatccgacacccctctggcacggatttcaatcagggccgctatctcgtttgcctcgtccgtggcatttaggccgaaggttttgacaaaccgtctgaacgcctccccgtccgcatgcatgggacagccggctgacggacggagtccggcgacaagggagtccggcagataatgtgccttttggggggacgaactcatgccggccctgcagagcgaacatggaggcgcaccttccggccgtatccgatatgcccttatcggatgtgctgaaatggtatgtctccagtttctccagcccgtgaagttcggggaagaaataccggtccgcatggtactgcaggtaactctccagacattgcagcccccggcccgagtcgtcgaacaggagtacgcccttgtccgtgcggacggcggagacggtacgctcgggcagggcattctcccttctttcatggtaaccgtggtacgcttccaatgcttttctggtatccggatcgtccagcagctgttccgttttttccagtatggtccacattccttccggcaagccgcctcccgtggtctcatggatgaacgtgaggctgcgcaaatcaaacgagggcaactcccggatatcgccttttcggatatagtcgtccagcagttccggaaggccgtcgtccgtccgttccgcacctgccaggcagaatacggattcattgggaacgtacgccccgccaagggccagctcagcctgtcggagcagatactcaccgcattcataatcgttgtggcacacggcatagtccaccagcctgtcccgcctgtccacattgaacaggacgaccggttcgctctgttttaaatcggtttctttttccatatcatgatattttaagtttctttatatcccggctggttatgacattttcctgccggcggatttacggggagtccttttcttcttcggtattttttcttgtgggctgacaggatgcgggataccgtcctttacccggtaggtcttggccgggaacggttcaccggataccagcaatttgttccgtgtaaagtccgccatgcagtatagcaggtgccgggaggagggcttcccgttctccggcagatacagggcgtttccttcggccagtattccgagttgcaccttgtccagtaccgtgtttcccacaagaagggaggtgtcgggggcattgaggtatttctccagtgaccggtggccccttacatcgaagtcccggtgaaggatatcttccgccgtttttcttattttaagggagagttccttaaaggcctgcacatcgaacaggccggcggatctgacctgggtcaccttttcgaactgttcggccaggggcagcagctcccggtaataggtaaatggtttgtcatggatgttcatataaccgtgttccctgatggagagtaggcggtagatatcctcgttctccggttttcggaagagttcgagccccatatatcccttcaccagggagaacagcctggaatacccttcggaagtcggattcatgggaacgtagagcttcggttcgaggctgttgatgaattctgccgggaggataccggaggaaacatacccgtcctttctgtcccgacccggtaaaagtcccctgcgacagctgctattgatatgggaggccagctcctttcggaaaccggaatactcataaatctccaaggccccgtcatgggcatggggatcgaagaaatggtcggcggtgtactggagatagctttcaaggccttcctttccggtatggctgtcggaaaacagcagatagccggactcccgtcgcaccactttcaaaggtgttgtcttgtttttcttttccatactgtctttcctgattttacattttgggacggtgtcccgttttctttttcgtatttttcggagaactgtacatccttttttccgtattccgtttgaccctgacggtttccctgtctccgggtggatggctgccgaaaacgatgcggttcgtattccggtccacccatgcatatgcatgagcgggatcagttctgatgctgcggggcaggaacaatccgaagcctgctttaagaatgctccggtgggaagcggatagccggaccccttccacgctgaccgtgggggcaggatcatccagtatccttcctgccgtgcggtgtccccggacatcgtaggcggagtccatcagcctttgcagctgcagcttggtctcacgggtcccgtccctttcatggggaaccgcttccggcatgcgccggagtgtttccagatacctgtcgtaacgttccaaggcctccagggtatcggtaatatttccgttacgccagctgaccgagcacccggcattgtggcagaaactgcggaaatcctctgccgtcggtttcatttcgttcatgtaacggacatccaaccggaaattctccggcttttgtgcatagggatatgccatgggggacattttctccggattgaccggggaaaggtcgtgaagcacgccttccgcctcatagacacacaccggacccaggttgaatgacggctcgaaataggtatcggccattccctgaaggagttcccgcaggcccttcctgccttcttccgtatgggtgaagaagaggaatccccgggctgtctctacggccgtataggtcagggaagggatatcgttccgtttttccagcctttcttcggggctgacagtccaggggaagcacctcatgatgccttcgggacagcagcttgagatttccggctgtctcatggattcctcgtccagcctgatgacaatgtaaaagtccgcctcattcctgcctgtttcatgaagggcggtgacggttcccctatacgggaaactttcgggggattcgggatcgttcccgacaatccgcattccgattctgacttgttcttttctgatcatggctatattttaggtttgtttcttttggatttcatttctttttttctcgctttcctctccggttccggatcaaccgggcggatcagcccgtcgtttgtcatccggtatgtccgcacgccggggaacggtcttgccgatgttaccagccggttttcgaacctgtcagccatacagtacgcccgccggcggttttccggggagtcattctccggcaggtgcagcgcgtgcccgtcggcaagtaccgccctttggacggagttcagcttgacgcggcccaccatgaaggtaagatccccgtcatccagctcgtttacgatggaacggtgccccctcacgtcgaagtcccttcgcaggatggcttctgcctggcggctgatgaccgaggaatagatcctgaaatcgtccgcgttgaacgcggcggcggttttcacctgtgtgacctgttccagcttccttgccaccggcagcagggtgtcgaagtacgtgaacggcttctcatggacgttcatgtaaccgttgcgcgcgacggtcagcagccggtagatgtcgtagttctcacggcttacggccgttcgtgtcctctcgtcgtccttgaagcgtgagatgaaactgccgaagctctccgcgtcgggacgcagcggatggctgtaggggggagtcagcccgtccgtgaatccctccggcagggcggacggggcgacatggcggtgaggggaaaagtcgaacccgtttaccggaaagtaaccgtaaggggcgtatgccgtgtcgatatggggcggcagcttcccgtccaggacggggcattcatagatgtccagccggcccatgtcgtagtgcgggtcgaagtaatggtccgccacatgctggatgcaggccttgaacccctccctgccgaccttgttgccggaaaagagcaggtaaccgaaaccgttctttaccaccgtaaggggcagcacgtattccggctgcaggcggtagatgtttttcctttcgcgctgttcctggaggaattcgacatagccgctctcctgcatgaagtgttttttcagcgcggaacagtccggcgttcctctggtcagggtggaatataccgcgtcggcaagggtgattttcttttccggcaaccggttttccgaggcaaggaaagggaggagcgtgtcgcgtatgtagcggtcggccgtctgtcccgtcccgggtggcggcacgttcttcatgctttggaagcggaagacgagcagcgtcacgtccggcacgtatgtgcagagggcggcggccttcacgttgtcgtccaggaactgccttactccggtttccacgtcgccctgctgcaggaaacgcagggcattttccgaagacggccggtaatggccgtacctgtctatggcgatacataccgtaccgggctgctgcggattgaaataaggatcggaagatagtctgttgtccatcatattatcgttttagttgtttacggttgctgttcttatgggcctttccgggcttgttctccttttgccagtctgaagtaccgtacccccgtaccctgaaatccgttctcaggatacggtccgacttttcccgtacctcgtccagtattctttccatgctgtcccctttggaaaggccgtttacgcaatcatccatcctcctgacgaattccttgaactggaaatggtaggcgaaagccggatcgaggatgatgtccctgtcgaaatgcctccgcagggtgagcaaccggcagatgtccctgttgttcccttccgggcggcagccggagaaatcctccaggcggcggtattccgtatcggagggttccatgtccgtgacgaactccagcgtccatcctttcttttccgacgccccgataccggcatacgcgtcgaaagggtcgaacgtgtacctgtttgttcccgcctctttccggcaggagaggtcggtgagcccgtacagcctcgcggaaggggaatccacccggtattgcctgacgggaccggattccatatgaatggaaaaatagttgcccagcaggaatttgtagaagctgtcaatctctttccatccgatatcgccgccgctgaacaccagcacgccttttggggtctcgatgacgcgcaggggcagtttgtaccgggggacatatttgtaccttgcggccagctcgtcctgccgtcggcggaactccgtgagacggtcgatctgtccggcatcgaggcggagaacgccgcccggctccaccggcagcccttcggagcgtatgaagaccatgtcgcgcaggttgacgcttacctgaggcttcagcccgttctccctgatatggggaagcagcccgccggtgatatactccttgacaggggtatcccggaagaagggaggaagggcggacatgcgggggaagcggtagacctccatacgggtatcagggatgaatgccgatatccgggcggtttccaccccgacatgcaggaggctgaggaactggtaggtcatgccgtcctggcccggatggacaggataaagctggtaggaagaggcggcatggggcttgtccctgcccgtctcgtagcagacaaggaggctgccttcgccttccccggccagcagctcttccagttgtttaacgttttcattcccggatgccatggcaggttacattttgggggttacggactgtctggttcgtctggccggtttcccggccgcctccttaagaccggctgcctgttcctgcacctgtctcttttccggcttcttcgtgcttctttcccacaggaattccgtaccgcgctcggccgcgctcatctggatggaggtctggtacaccttcccgtttgaagacttgaactcgatgggaacctcttttccggcggcgtagtcggcatactccttgtcgctcagcgcatagtcctttatcttgcgcgggtggcgggcctggtctgccgggaggaaaaacatctcgttggttatcgggtctttggagaggtagcagggcttcatctccctggtacggtaatccgtgaccagattgacgagcctgcccgcgttgccggtacggttcaatgcctccagcacgtcctcctccagtttgtagccccggtattcctgtccgactttcggtgcctggcggatgaagtgcaggtcgaacttgaccgccccgtcctcgtcgcggaagagcgagagcttggcatcccctttttggcgtcccagctcggtgttcatggagatgtcgtaggctatgccggactgtctgccctgcaacagcttctccatgtcgcccgtctgcctgagcacgtccggggtgagcccgtaacgcgaggcctgctcccagttgatctcgcgctcgttgaagaaatggttgttatagatgcggttgttcctggagagctcgcgccgcagggcctcgttctggggctgctgggcatcctcgatctttttcgccgcctgttccaccgggcagctttcctccatccggtagagggagaagcgtgtggggttgttgtactggtagaggaagttcttcccgaagttggtgaagaagttcccgaagcggtccacgcggatgaactgccccttgttctgctcgttggcctcgagcgtctccagctccccgtttgccgcgatacccttgacacctttcgctttctgttccttcttgtcgtaagccatcaggtaaccctgttcctgagtggcgttttcgctgccttgcgcagccggttttacttcttgcatgactgttaaatttaaaagtgagtgaatcgtttcgggaggtaaaattactatcttcgccattaaataaactgattatgagaaagttgtcattaatagtcatgttttgtcaccttttgtcgctttccgcttgcctggatggcgggaaggaaaggccggaagacagtggagaaatgttaaacggacgtgtcccgggagcggggaaacgggcggaggaatgagagctgcggcaggcggtcgccatcctggcggattacccggtactgttcccccttgacggcaggcgtacccgctaccgggtctcctccggattcgggagcaggacgcatccccttaagggacggaggatgttccataagggggtggacctggcggccccgtatggcgagccggtatatgcggcaggaaacgggaaagtgtcggaggccggttacagccgtagctacggatggttcgtccgcatctgccatgagggtggatactcgaccctgtacgcgcacatgagccggaaccttgtaaggaaaggcgggacggtccgcatcggacagcgcatcgggctggtcggcagcacgggagcggccaccggcaaccacctgcatttcgaactgcaaaaaaatggccggctgttggatccgataaaatggttcggccggctattctaaattcttaccattatcaaatacacgacgagtcatgaacattgaagaagcgaaaaggattccgctgggagattacctccggcggatgggattctcccccgtaaaggaacagggggacagtttgtggtaccgctcgcctttccggcaggagcgtaccccctcattcaaggtcagcctttccagaaacctgtgacatgatttcggcgaggggacgggaggcagcatcatcgacctggcgcaaaggttgtacgggacgcgcgacatatcctccgtactgaagggcatagagggacacttccccgtgtccacgtccgccccggtaccccgtaaggcggtcgccacgccttctgcattcgaggagctccgtgtctcgccgctccgtaatacggtgctgctggattatctggccaaaagggggattccttccggcatcgctgcaagggagtgcgtagaggtgcattaccgcatgcggggcagatggtatttcgggatcgggttcagaaaccggaagggcggcatggagatacgcaacccttatttcaaggggtctacctccccaaaggatatctcccatgtcaggcattcaacggataaaaatgagagatcgacggtcctggttttcgagggcttcatggattacctctcttaccttgcgctcaaacaggggcagccggtgccggattgcgtggtgctcaattcggtcggcaacctggccggggcgttggacgtgctgaaaggttacgggcatatctgttgtttcctggacaacgatggtgcggggcggaaagcgacggaggagatcaggaggcggtgcgggagcgtgacggacaaggcggtgcactacctgccgcacaaggatctgaacgaattcctgcagcaccgtttgaaaaagacggtggaaacgtgtccggaattaaaacaggaaagcggatgaaaaataagaaggtcctaatacaaatctggtaggttgatgacagtgagtgtttcagacgatattttgtcatctgatgcgccattgtcatcgacaagcgttacggaaaaaggcggaatatgcgtctgtttgtcagatttctgtattttgtgatgcgttttttacgtgagtattcagtaaactctctttagttttgtattatgccattttgtatccatatccagagtaaaactccatcatttttctcatcccaaatacaaggataaaatcgaataaagaataaaggaagaaatgagacaggtttctttaggatttatatgctgataatagattataacgctgttctgagatgttatcaactgcagaccagataacgtaaaaagtaccctaaaaagggtgctttttacatgtagggcaatgaaaccatgctcccgcaaattaaaaatatcattttggatccgtaatataaccggtccttcactcaatcgtgagttccgtttctaaaagtaccacattttttgccggatatgaaagattgctgtctggaagtggtagaaaaaagaaggccgattccccgtagtccggaattatgcggatctcatctggcagtcttcaaaaaatctaccggtcatttcaaaattactgaggaagcattattttataaacttgctttattgaatcaggcggttgtggcacctcctccttgaactggaaatcggaaaactaaacacgaaaaagcgaattattatagctataattgctgcaacggtatggaatattaaatttgaaagagatatggagctgccgttaggtaaagaaatgcaaaggtataataaacaaaattgcaaatttaaaaacagtagtattttggggtaaaatgaaattaatcgttaaatcgtttaacggtaagatgggttaatcactcagcaggttcaagtttattcttatcctttttaaagattgtatttctgccattttccaacttcctctttgccccttcccagagtatatcatcttggtgtagccggttgtttttggccattcggatttggagcgcgggaagtgacgaagtatgggatattttcttccacgttctgaagacaggctctgccggctataataaaacaggttaatctgacatgataataaccggcaaaccatgatgaggacgataaatcatttgagtatagtgagaatagtacaatcgctttataccgtacaaagggatgatttgaatacaaatccttctatttcgttccttcaattcttaccgtaaagatatcctgtgtgggcagatatcggggtgcgggccgttacgacattccgtactgcaactgttgcggaactctctcgccctcagcctgaacgataaggagacggtactcagggtgaaaagcctgacttccgacaagctggcggaatgtatcaacgacgggagtttcacccatacggaagactacgtgcgctttatggaagcagaattttgaccatggaaactgaaaaaccggaaaaattagaaaacagcaggactgcaaaatttgctgaccggaacggaatcagtatatttgccccgtgtaattcgaacaagtggaattttccttgtattccaccagacagtttcgactatctcacggactgcaaggacaacctttctggaaaaattgaaaaacaatacaaaaccccaaaagaaagaatcatgaatgagaactgacctgaaatagtggaggacctgtcgccgtatcttgagacggggcgggataagaatgaatgtctgcgcgatataggaaattgtctcaggtatctcggctggaagaaaaccaacgggacgatggtcttcggacacaaaccggttcccgatgacggggagtccgtacagcccgatatctgcctctgcataaaaaacggggaaaatgctcccttgccggtacttcccgtcatcacggggatacaggacacggaaaaacgtctggcattgttcatgaagcggtcagggttcaatgtcgcgttatatataggccgggacatcgggttgtactacagggttcccggcggtacggaagaatccgtccgcgtgcttgccgctgaattccgcaaggacgacacggaaggaagcgagatttgcgacctgctcgcttacgacggcttcagcccggagaaaatggagcgcttctgcaaagaacgttacaaagaaacacattaaacttacggacataaaataaaaaagtggagaaaggcatcccgttgatgtttttctccacttttgatatgaatcgatgaccggtatacagtcaaaaccgactttgaagcatgggccggcatgttacccccggcgtctgcatggtctcatgctcctcccgtccggttctatcggggaatggctgtcaaaaagcatgttccaataactgctgctgactatgggcgtctcgctgggcgggaaatgcttgttgatgcggtcaaccgtattgttcgcaccggaacgcgtacagcttgccacggcagcggcgggtttcttccttttgacgggaactcccgtttaccaaaggcactttcatctcagcaggggcagctggttcaacatttccttaatacggatagcggtacggggcatcggttcggcaacggtcagccctacaatttctttctcctgtgcgatgccgtttatcacacgcaccacttccgcgatcttcatcccgtcgggaacgacaccgactgccgctattatttcggcgggatcgagcacgtccatatcgaagtggacaaccactttcgacgcgccgcacgacttcaaccattcccgtatcgcgttgctgttctctcgcacgtcttccggtgtcagatgtttgataccgtatcctttctgtctttccttgatttcgtcgcgttcccaatcgcgtaaaccaataaaaaggattttagacggatctatccttgcgggcagttccgagacgatttgcctgtcacccaaccccatgcaggccgttaccgccatggcatgataggccgggtacacgtcgccgggcagggtgatgtccgggtgcgcgtcgatccagaccattgccacatcatccttgtatttttccgaaagataggtaaacggcacgacgcttaccgaacattccccacccaacgtgacaatcctgtcgggtgactgcaccttcaatatatccagagcggcctttgtctgcgcgatgatggcatccttgtccaaaaccccgtccgtcactttccgctgcacgaggtctgtggccaccggaacggtgtatgtcttctgcccgttgtcgggtgcaaggaagttcaacaactgcgcccctaaataatatcctctcgacgcctgttcggggtctttcacttccgttatccaccgggcaatgtcaccgccctgccattgcggataaacgagcctgattgtctttaactgtttttccatattgcttttactgataatttcctgcgcatggaccgtcatgccaatagccaataacgtacccaacacaaataattttctcataatcataataaccgtatctgtttttgccgcaaaattaccaaactgcttgcagtcatgcaattactgctgaattattcatatactgataattttatcctatactggcaattttatcagtatacatgaaaagattatagcaggaaaagactaattttgcaccatataataaacgaaattatgtacgaaaagaaaataccgttcaatatcgactgctgcatcaaggtaacaatggaagtcatcgggggaaaatggaaatgctgtatcatagacgcgctgaaagacggggcgaaacgtccgagtgaaatccacaggcatttttccgaagcgaacacgcgggtcatcaaccaacagctgaaagagctggagatgcacgggattatcgagaagaagatttttgccgagctcccgcctcattctgaatattccctgaccgagatgggacggacgttgctccccatcatcggtaaacttgaagattggggcaatatgttccgccctacactgaaaaagatatatggcatagaataataatgttcgcgttcctatcgggtaaacgggagggaagcgaatgattcctcaaattgcaagattatcttttctgtatttacccggcgacattcctttttctttcgtaaagacccttataaagtggggcaaatcactgaatcccaccagataacatatttccgacacggatttctgcgagtgcttcaacaagccgcaggcggtgttcaaacggtattgcgtaacgaactgcaagaacgtcatccccttatgccgcttgaaataggtgcagaaagcggaacggttcatgcccacttcagcggcaatgtcatccaacgagatcgggtggacgtaatgtgccatgacgtatgtgcagatctgctgcatacgcctcacgtcgcgctcaattcgtaccggcttgccggcaaacgtgtaatccgttgcggtgaagaccgtcggcaagagatgaaacatcgtacacaggcgtcccaattcatccattccgctcatctgcgaaagcgcttgccggatagtccgggagctttccggcccgaatatcagagcctcggtcggaaaggttatacctgcaagcctgttccgcaattcgggaaacgcctcgatacacttttgtataagggagtgactgaaagccaccatcaggtaacggacacatcctttatcgtcggccgatgacggctcatagtcccaatgatggtgcattgaaggtggaatcagtgccacgtccccctcggcaaagggtagtaaggtatcgccggccatccgtgtcccatgtccttgtatgacacaatacaactcccaggcatcgtgttggtgcagcttggcctccagccgggtgtctatccactggtctatgaaaaaaaacgagtggttctccacgtccggcagttcatacgggattatagcatcttccatcttacaaaatttaatattagcaaatatacaacaattatttgaaacgataaagcaaataacaaacaacaaaccgcactacctttgcaaatgtaaataacaatatgtccaacataataaacgaattgcattatggatttctatgaagtattggagaaacgccgcacatatcgcgatttctccgaccgtgaagtaagcgacgagattttgaaaagagtaatcggtgcggcattcaaagcaccgaccaacgaccacctgcgccagttggagtttgtcgtggtgcgtggccgcgagaatatcgccaaggtgatcgccccgctcgccaagaacatggcggcgttcaaggagctggtagccgaggtggacgagtccgacgacaaggacaagatggcgatgttcgccgacgcgctgcccaaacagcaaaggatgctgatgcagagcggcctgctcgttatccccttcttccgtcaactgacgtggccgttgctcaaacccgtggagcaaagctcgctcaactatttcgcttcggcatggtgtgctttggagaacatgcttcttgccgccaccgccgaaggtctggggacggtattccatatccctgtaagcgatgaagcggagaagatcaagcaaatcgtgaacgctcccgaaggctatgagttcacctgcctgctgacaatgggctatcccgccgagaacgcattcctgcccaggcagaaggtaatcgacgtggaaaacagaatacacaccggcatttggtgaaacgggctgtatgaaaggacatgtcctcatattgacagcgaatatcctgttcggtgtcagtatgccggtattcaaatacctgctggcatcggatttcccgccggaggcgattacctacatgcgtgccgctttcgcttgtgcgatattctggatcgtgtccttttttgtcgcacccggagagcgggttcccccgaaagatttgggagcgcttgctgtttgcggcttgtgcggcgtgggggtcaaccagtggatgttcgttactgggctgcagagttcttcacccgtcgatgcgtcgatcatcgctacagccgtaccgattttcgtactgttgctggcggcggtcgtactcaaagagccgataaccgcaaagaaatcggcgggtgtcctgctgggtgtcggcggagggctgctgctcgtgtacagttccgtgcacgcgacggacggcgaaagtagtctgaaaggtgatgtattgatgttgttgaatcaaatgctgtactccgtttatctggtattgtccaagccgctctcattgcgctactcgccggttacggtcatgaaatggatgtttcttttttcggcgttggcattgacgccgttctgcctgcggcatttacaagaggttccggttttccatcgggaaacattcgacggcatggagttgtgcgctctcctttatctgctcaccggagccacattcctttcgttcctgctgattccagtggcattgaaatatatccgtcccaccaccgtcagcatgtacaactacgtgcagcctatcgtggcctccgggatagccgtcttgatcgggcaggataccttctccttgcagaaactgacggcagccgtgctggtattcgccggggtctggctggttacaaggagcaaaaaaagggacaaaataaacaggtagaaaagacctgtcctgtaaatgacaatgacggaaagaataaaataatgctttgcttcatttatctttccgtcagtatatgtttttcagtgacaggaaaatcccatcaagtgtctgattgaaatacaacaaatccttacctcaaatcagaaatagaaatccagagagatatacagatattccttgtggtttatcgtgtccgtttcaaagaaaatcttgtcttctcttgccagccagccaatagcagtatccagatccctgtctgacagtcctgatgcggccttgagagcctcatactcccaacgttcaccattattcaacaaattccagatgataccggcattcttaccgattatgtccttgtccataattaacctgtaaaattattcagttcaacatacagtacctttctcttccccacctgcgtttcctcaatggtgagttttccttcacgtgccagccagccgatgcccgcattaatctcacggtctgacaatcccgttgccttttttatttcctggcaagtccattttctctgttctccgtagagcaaccgccagatgataccggcattttctccaatgctttgtacatccatagatatagacttttatgagttatgcacgtatagaattccgtttttccgctcgatgaagaccttatcctcacgggccagccagccgacggccaaagttgcctcttcaactccgatattcaactttaatgcgagttccgggattgtgatactgccggtttcgttcagtttatgccaaacggttccggctttctgtccgatgtttgctttttctttttccatcataaaccaacaaaaaaaatgcggtagagcattcctatcgttagagagggagtcgaagcccttgaacacaaacaggaaacgccctccgcagatatgacggaaggcgtgtaactgctttcactgtgttcataagatactttttcgacttttctctaacacggaaatcagctaaacgcttaaatatatcaataaaatttcttagctccaaaaagctgctgcaaatttatatgttttatttggataaaagcggctctttcacctcttttttccaattatttcccgtgcatgacgaaatatgcgttcaatgccccccaaaaccgaagttgaaggaataaagcaatgttaacgttcccccttggacgaagcaatcccgcttggtatttttcgtcattttataaaattaggaacaaccaactgttatcggggagtttttctttcattcatgtgctctttcagcagtcggttcaggcttctgatatcgatgcctaaataggaagccatatcagatttggacagttcaagattctgacgtgcctgggctgccaaaagtttttcaaaagcatatcgaatgggataaagggcgtaaaatgatgcacgggccgtggaatccgccatccgacgggagacctccgtgagaagcagccggcagaacacgtggtcatggtcgcaaagataatggaaatgttcgacgctgacaagataagcatccacggcagtcatggcttccacggtattcagataaagactccgtccggccaatgcctcttcctcacccagcaccgttcccaatccgaaaaaatccaggatatactctttggcattctcttcggtatggtaggctttaacgagaccttgccgcaatatatggatatagcgtacacgactaccctgactgcacaactgttcccctttatcaaacttgcggcacaggataattgctttcccttgccgttgcgaataaagggaatcgataaaagttaaaaaagccgtatttgttcttaacatattgtcttatcgggacatttgtccttgcttgaaaaaatggtccattctaattttgcacacaaaattacacagaataatcagatatggatatattaccttacataaatacagatagatatgagatataaacatttgatattcgatattgacggaacattggtaaacaatgaacaagcagtaataactacatggcagcaaaccctccgggagctatttggtaaagaatatgcgacggacgagctgggtttcgtgctcggcatacccggcgaaacgtccatgcggaaatttggagcggcagatcctgcggaggcgttcaaagtttggggaagaaacttcatgagccgcaagtccgaaatagaactctttcccggaatagaaaagaccgtctcggcattgaagcaaagaggcttggagctgggaatggtcacttcgcgtacacgcgacgaactgaataacgattatgtcctgggtcggataatcgacctgttcggcacaatcgtgtgtgttaccgatacggtgaaccccaagccccatcctgaccctttgctgacctatcttgacaaatgccatatcacccggcaggatgcgctttatataggcgacagcatgtatgatgcccgttgtgcggatgctgccggagtcgatttcggattagcgcaatggggcggtcatgttggttcagacgacatcgtgtccaagttcctgttcaaaactccgaacgagatattgggtgtcatatagtcaattgcagtttgtagataaagaagaattgataagggaaatatccgaagaacttggcggaagtatgcctcaatctcaaattcatgtgatgaaatggaaaaatttcggtttccaggttgtcaaagagtttttttcgaagcgtttttactctccgatgttgaaaatgcacactgtttccaaaggtgaaaggaaaacggagtttgtccaccttgggcaaaataatctttttatttgcacgtatttttatgaaactgacggtagtagtgtctgttattccggaaggaaaaatcgcagagatatcgaaagccgttgtagtacgtaggcggactccacttggaagaacattaacgagaatttacggcgaggcacataatggtgaggatagcgatggacaatacaggtcataggaaactggcgctcaaaatcaacggggaacctattggagaatgattcaaagagtaatttgagaaaatgaagccggacatgtaccctgtaaacagtaaaaggtcgtcagaagtacgaatttataaaaatattcatataaaaaatgcaaaaaaaatgtggcataattgattttttataaatttgcgtaactgattacgtttcatataacacatataaattatggatttctttgacaaaacaggcaagatggctatcggcagcaggctgcggttgcttacggatcgtatcacggcggatgccaccgacatataccgcctgtacgggaacgatttcaagccgaaatggtttccggttttctttgtgctggcggacggtgaggcaaagaccgtcacgtccattgcccatgaaatagggcattcccacccctcggtgagcaacatcgtgaaggatatgaaagcccacgggctgattgccgacaatgcggagcattccgatggcagatgcaaccttgtgcgcctttcaaagaaaggtatcgggatgacggtttccatcagggaaacgtgcgatgatgtggcaagtgccgtcgacagtgtgtgccgggaggctgcccacgacctttggcgggcaattgacgagtgggagcgtctactcgcggaaaaaagcctgttgcaacgggtgaaggaagcacggaaaatacgggagaaagcggatattgcggtcattccctacgagcctcaccacaaggaactgttcaagtcgctgaacgagcaatggataacgcagtactggcagatagagccgcacgacttggactaccttgaccatccgcaggaatacatcatcgacaagggcgggttcatcttcgtggcggtttataagggaacgcctgtcggcgtatgcgccctctgcaagatggacgacccgaagtatgactatgagctggcgaaacttgccgtctgttccgaagcgcagggcaaaggcatcgggacgatactctgcaaagccgccatagaaaaagcaaaggagacgggagcgaaagccctgtttctcgaaagcaacaccctgctcagacctgccatccatacatacaggaaattagggttcagggagcttgcggagtaccacccggcatacgaacgcggaaatatccagatggaacttatattgaagtgactcaaacctatttaccgatatgaaaatcgaacaatacattgttgatgcgtttgcagagagaatattcgagggcaatccggcagccatctgcgtacttgaaagatggcttcccgatgaactgatgcaaaagatagcatcggaaaacaacctgtccgaaacggcataccttgtcccggcagaaaaatcctacggattgaggtggtttacgccgaacggggaaatcgacctgtgcgggcatgcgacgatggctgctgcctatgtggtggcaagctacctcgatgccggaaaaaccgacattgcattttcgacccgaagcggtcgcctgacggcaatcaacaaagaaggtgtcctttacatcgaactacccgctttcggcctcactcccgtttccgcaccggcatcgatcgtaaaagcaatcggtgtggagcctgtggaaaccttcatggggcgggatatgctgtgcgtgttgcccactgccgaggatgtaaagggggtattgccggatttgaatgagatagcgagttatgacgggcttttattccacataaccgcccgtggcgaggactgcgattgcgtcagcaggacgttcgccccgaaatgcggtgttccggaagatgccgtatgcgggtcaggacactgccatatcgttccatattggagcgggaaactgcgaaaggcggaactgacagcccgtcaggcatcgccacgcggcggcacattgcattgccgttattccaaagataaggtgatactcggtggtcggtgcgtgctcttttcggaggctgtaatccgcctctgactgcttatccgctaatacataatcggttgtcaatacaaacagatatgttgagcaaattattcgttttgagtgtagcagaattatgtcgtagttctcatgaggaggacagaccgaaaacaaataatgaaaaaatgtccaatttaaaaagaagaaagatggagaaaaaaatcgtagtacggaaagaagatgccttgaaaaaggttttcaaaggcgtgtcgctcgattcgcttgctgtcggcgagaagtcgatggtaacgaagatgaactatgtaaaaggtaatttcgccaccacccaccaacatccgcacgaacaatgtgggtacgtcatttcgggcgaataccgtttgaaagtggagacaccagaggaggaaatcgatgtgctgctccacgtgggggacagttacgccatccccggcaacacgccccactcctttgaggtactggaaggcggcgaggtggtggatgtgttcacgcctcaacgggaggattatctgtaaatccgtagtatttgaggcaaaagcaatctgattcatacgatagtgaccaaagagacgggattaccccttttctttggtttttaattaatgaatgagctccattttgggcatccccaaaatcccatattacttctctcagagaaagagtcatttgacggtagagtgccgcaaaatactaaaattcttacaaataccgaatcgctacctctatttcttaaaaaattgccaagaatttattctttaatcagttaagttaagccgatgaaaatctaaaatacaatatatcgaatatactattcatcaaatcatcggatttttcatccatcatcagttcgccgggaaaatatgtgaggataattccccatagcagaagaaatgcaattattccaatttgcaaagcaggcatacggacttgacggtttcaaggttggatggctatgctgcatagccctttcgcttcggatggattctcgccttaattccgtctttctaacgcctgttccttgtctgagtaatttgagttgcttgaaacaggctccttttgttttggcgggtagcaagtttatgtttcggtctgcccgaaaccacttgccaccctcttcccaatcataaggaggggcatcccgttggtctatacagtggctacaatgacagcacttgaaaacgagcacaaataacgggcaaaggcggttatccaagaaagggcaaccaccattcaacacacaccataaagtatataagtaaacgactgaagcaagtctaatcccagacaccccatataggtatttgcacggaaaataccatagcttattagggaattttccgagccgcaatactccgtaccgctgaaaattccccaataagccaaagaggttgcacctctctggactcttcctaatcaacagtaagaaccgtgacttttgttttagaacattccaattccaataatcctttttttgcatcaagacctcctccgtaccctgtgagtttatgattgctgccgattacccgatggcagggtacaaagattgagataggattggtggcatttgcggatgcgactgcacgcactgcctttgggttgtgaatgcgacgggcaagttcaccgtaagatatggttgtaccgtaaggtatcttcatcagttcttcccatacagtacactgaaattccgaacccgtaaagactacggggatgtcaaacactttacggtgtccggcaaaatattcttcgagttccacgatagtccgttcgatgatgtctgaagtcccttcttcgtacttcgcattcagatgccgctgtatgcggcggtctatcgtatcacggcgtttctccacagcccaatcgcaaatacacagtttgtcaccgtaagacccgacaagcatttcgcccacgggtgattggtatcgtttaatctttatggtttccatattgttccttttattgttgtggaattctttcatgcatattttacagggtctgtatccgttttgtaaggcttcctcaagcgtatcataaaacacaatgttcttttcccaaggcttcgccggacaatccggtgtgcagacaattttcgttgttctgacagcaacgaagaatttgccacgatactttgcgtctctattccttacggcttttagtttttcttctgttttcattgtacttattattagtcggtgcataatctttcattccttctattgcacctccggctacggcccaaaaataaaggcttgcgatggaagcataaggcgaaaaccgcttcttatatcggtcgaacagttgtctgcttatcattttatggtgatagaccatacgcatacctcgcaaaagggcgaggtctccaaaactcaatatattacggcgttgcatggaaaacagcataagcatttcagctgtccatattcctataccgtcaagttctacgagtttggcacaaacctcttcgtccgacattgtcctaagagattcgatgtcgagttcacccgataagactttttgtgcagccgatttgatatatgccgcttttttgaacgttataccgaaccgttgtaactcctcatcgctcaaacgaccaatgccgtgaggtgttatttctccgagagcaaccaccatcttatcccagattgtcttatgtgcctttgtcgaaatctgttgccctatgattgaattgaccaaagccgcaaacaagtcgggaataacttcccgctctatcggccctaccttttctataacctcggcaagccgtttatcccgttttttcaaataagacacctcggtctcatcgtagacaaaaatatcacggtcgaccattggtgtacttattgcaaaaatattcattggaatcctttggagcctcattccgattggatttgtcatactctcttatgacggaagcaacggtgatttggtaattttcaaaaagtttttcacgaccttccgattggctcatgcggtgatgaaattcattgcgccacttttcaacggcttcttcgttttcccatacattcagcgacaacagcttaccctcttcatttaggctgctgaaacgttcagaacgaataaaaccctccacatttgaaagcattgattttaatagggaagcgagttcgagatagcgctctttaccctctgccgttggtgtcacttcaaaaagaacgaccactttttcgttgttgttttctgtattccttaccatttgtttttatatatttcgttgtttttcgtcttatggttcttctacaatccgtgttgccatcttccgggcgttcttcaaatcgcctgcaatgatgtatctcaacaaactctcgtgagaagattgcgaatttacgaagcaatccgtaccatcataaatacggttgaactccgaaagcagatgttgggaagcggaacggtaaatgtctgtcaatattcgattgtgggtggcttcggcaatagcgatgtgaaaatccaggtcggcttcaatacattctttcaataaaccgtctttcgcatttgcttttcttgctttaagggaagattgcattcgttctatatctctttctgttcttcttgccacggctttctccacaattgcaacatccaatagtttcctcacttcatcaagctccgtccggtcggcaatactcatatttatatcgcctccgtttgcatcgggcgctttggcgacaaatgttcccgctccttgccggacttggacaacccccatatttaccaacaattttaccgcctcacggacgcttgaccttccgactttgaacattttcatcaactccggttcggtcggaattttatccccaattgcataaactccttccgtaatctgttgcctcaactgctcggctaccatatcagccaaagatttcttctgtataatcatgttctacctttatctttaatcatcatatcatcagatgatttgcaaaagtatatatttttatctgatggacaaaatatttcgtgacaatattttgtccatcagttgttttgtagctgaaaatcactaataaaaaagccgattatttgatggactatgcttacggcttttaatatttatcttggttatagaggatacgtcattttttatattgcatattagcggaatttccttatccttttccaaaaatattactacctttgtacttgaaagagttatttgacagcatagcaccgcaaaacgctgaaaatcgcacggttgccaactcgttaccactgtctctcaaatacttggttaaatgtttatttatcaaatggttatatcaggccgttaaaaatctaaaataacatactgcacgacattttctataaatctttttgtagttttacatcagctaaaaaataactctttggctggtatcgcaagccgggctcaaatgtaataaggcaggtaattagaggcagaccaagatgaaaaaagtttttttatgttttcataaatggtatttttagtatttttgcatccgatttttgaaagtgagcaacatgtatatttctaatcttttcacaacgaacaatcccccggtggcagcttaaggctgaacaaccgatatactcttcccgctatcggattatagcggaaatcacgttatgtaatcttaacttcaaggttgttcagccatttttatattcttacttagtggctaattaaacaactttgaaatgaaaaatctcaaatacattttgatggttctgcttggtggaaccatgtacggtaccatgtcttcttttgtgaagttagcgtaccgaagaggcttcaatgccgcagaattatccttctggcaggcatttctggcagccttgttattggggctttgtgcctttttatcgcgtaaagcagaaaaggacaatatccaaagcaaggatattctaccgttgattctgacgggttgtgcaatcggactgacgaattttctctattatgaatccgtacagtacatttcggcatcattggctatcgtaattctaatgcagtttacatggttgggtattttgctggaatggattgtattcaagcgaaaagcctcacgcttggaaatgctgaccgtatttttcatcctgatcggtacggtcatggccggaggtgtacttgaaacggacgaatggactttctctgtaaagggaaccttgctggctctgagtgcatcgctgacctatgccgtttatatcattgcaaacggaaggtgcggaaaaggcgtgcgatggcagtcgaaaagtatgatgatcatgatcggctcctcgctctgtattttcctgataaacagccaaacggttttgtctggaaattatctgtgcaacgagtttgcaggttgggcggtatttcttgccgtaatcggcacgacgattcctacggctctgtttgcagcgggcatatcgaaaatcggagccggaatcagcccgattctgatgactgtcgaacttccggttgccgtgttgtgcgcacgaatcatcctgcacgaacggatcactccgttgcagtcggccggaattatcatcatgttggcgtccatctccgccatgaattattacaaagtattaaaatcaaaaaagtaaaatcatgttttatataagtgaaattatgaatgtagccccgactacgttcaagacagcgttccaaaagacagtttatgaaaccctcgaaaaattgaatattccgttcgaacgggtcgatacggacgaagcaatcacgatggatgattgtgtggccatcaatgaaaaacttgacatgaagatggtcaagacgctttttctgtgcaaccggcagcaaacggatttttatctgtttgtcacacagggagacgaaccgttccgttcaaaggatttcagccatgcgctcgatatcgcacgggtatcgtttgcacctacggaactgctgtacgacatgttgcaaactcctgtcggtgcggcgacggtattaagtacaccgacagataccgacaatcgggtaaaggtcgttcttgacagtgaagtgacggcggaaacgtggtatggttgcagcgacggcacaacgacaagatatctgaaattgcagaccatggacgtgcttcgttatcttgatggaacgaaccattgccctgtaataatcacgatataacgctatatatgagataaccgggtgtgcatcagtagttgatgtacactcattcttttgtcgcatattttcaagtttgtaatcacgggcttctcctgcaatatcactggcctctctcacttaatccctgttcagattcagtgtccgttacgcgtcaaaaaacacctcgttgtcatagtccgtggcaatctttatggtgtcccctttcttgaagaaacggctcttggccacgtgcaggcgcatgacgttctccttcctctcggccgatgactggttgagcgagataaggtgcgtgcaggggcgcgccagtcctttggcctcggagcagttgtattccgtgagcacgttcctctcgtcgttgagccattcgcggtcctcgatggtggactggtaggtaactaccatccacaccttctcgtcggcagcaaggtctttcaggtcgttagccacggcgatgcgcttggcccgttcgtggcccgcgtcccacaggcggcggttggcgtccgtcaagaggtccatcgagtccacgatcacgatgtccgggttatgccctttgagcttacggtactccgagatgccgttcttgatgtcgagtgtcgatacctgggcgttgaaacgcgggtagctgcgcacggtgatacttccggcatacgagagcaccagtttttccagatggcacatctccgtgtccgagatctttcctcgctcgaaatagtaggcgttcagcgcctcctcttccgagctgcctgcccggaaactttgtgatttcgcgttctaatcctttaataatccggtaatgttcaatacctttggtacgcgagcataacagtcttgaagaagatcattcccagtttgaccattttctggtccttggggttctgcttgccccgaatgttaatcgtgtacataaactgataacgtgttagttaataggtactttcaattcacattagtaagcatcaagtcagcttgattaacctacatagaagcctacatgaaaagagtaggattcccagtgaaagaaggttcgcacgggttgaaccgtacttacaccttttaccaacacgttatcaatcagtgtatttcaagtttctttgaaatcagttgcggaaaaaggtcatggtagttagggcataaccttaattttcggcccgcattaatagttccttatcagcagctcgttgaccgatttccgtttctcggcgatggagcagaccgagcggaagatgctcagccgctggatatggaagccgtcgtacagatcatcgaagaaggtgttaaggggattcttctcgcgaggatcggagttggaaagcattcatttgctgccggcatcccctatctccctgcagaactcggccagccggatctggtcgttgtcgtcgaaatcgtcgggcatgtaggaggtatagccgcccgcctcgttgaccggcttgtagggagggtcgaagtagaagaaggtcttcccgcccgcgtatttgccggtctgccgatagtccccgtccaggatgacgactccccgcagcagttcgtggttcagacggagcagctcttcttccagtattctcgcacggttgcccgcgccgaacgtcacggagagcttgccgctgcggttcaccgaatagatgccgttgtagcaggtacgcatgaagaagatgaacagggcggcgcgggtgacgtcgtccggattcccctcgttgaagaatgtacgcctttccatgaagtatgccctcctgtccgcgtgttcctccagggcatggtattctctctggataccgtccagcgccccgattagctcctcatgggagttttgaatgatgcggtacacgtttatcaggctctcgttggagtcgttgatcacgcagcggatgtgcgggtaggcctgcctcagtcagaagaacagcgcaccgccgccaacgaaaggttccacatacgtttccatttcggaaaaattacccggcaatgacccggtcaggacgggaagcagccttctctttccaccgacccaccggaagcagggttttcccgcggggctgttgtttttctttttctcggtcataaaactaaaattaaacggttatcaaatgtcggattgcccgaagcaatcctattattatatacgttattcctcgtccgtctccagcaggtgctgcagtttcggatcgttctctatgcgcaggagttcgcgccggatgatatcgcccacctcttccttgatgcggtaatagttgcgctcgatctcctcctgcatatggtccttgccgtccccgcccgtgaagtctgtaatgacaggtatcggtttgtaagccttcgtttcggcttccaccttggcattgtccaccacgatacgggcatggaagatcttctgcctgatggtttctccgaaattgtccgatacgcttcccacgaacatgccctgtgagagattggatatcttggaggcaggtatcagggagtccagctgggtactgatattggtggaagtgtcctccttggtcatgttgaccgatttgcgttgctggagcaccttgccgaaacgctcggaaaggtttttcgccgtttccccgaccacctgcccggcaaagatgttgccgatggtgttctggatcacgcgcgcctctttctcaccgtagtcgcgtaccagctggctgaagtcctgcgctcccaggcagaccgccaccttgttgctccgtgccgtggcgatcagcgtgtcaagcccccggaaatagatggtcgggacctcgtccacgaggatggagctcttcagctttcccttccggttgaccagcttgacgatgcgggcgttgtaaagccccagggctgccgaatagatgttctgccggtcggggttgttgcccacgcacagcaccttgggttcctccgggttgttgatgtccagcgtgaagtcgtccccgctcatgatccagtagagcgaggggctgatcatgcgcgagagcggtatcttcgcgctcgctatctggccctggagctgctccatcgccccgcccttccatgcgtccatgaagggcgagaggtagttctcgagctccctgtacgaggtcagtatggtgaacacctccgaatagggcttgttcagcaattcgatggcatgcgggaaggtgcagtatttcccgtcctcgaaaatcttgaggtaccatataatggcggccagcaggatgatcggggattccacgaagaaatcaccctgtttctgtatccaacttttgttcaggttcagcatgatgacatacgccgattcgtaagcgtccgcgatatccgacatgaaggccggattgatcgggttacagcggtgactgcggcgcggatcatcgaagttgatcacatagaactgcacgttgccgtcatacttgtccctgttcttgagcaactggttgtaagctatggtactcaggtccggatgcttgaagtcgtaaatgtagcaggcgaagcctttggcgatctgctggcgtatgtaattgttgatgacggcgtaactcttgcccgagcccggcgtacccagcacgagggtcgcgcggaacgggttcaccacgtttatccagccgtcatgccatttcttcttgtaatagaaacgggtcggaaggttcaccgaatactcgctgaccatcagccgggtctcctgcatgaaggactcgttttcctcgttgaacacgtcgtccatcagctggttcttcaatagacgaccgatccacatgccggcggtcaggagacagatataaccggcggtgacagcggacacgtacagcagcgtggtgggccggatgtcccaccctgagacgagcagcaactcgctgccgaagtaaagggacaggccggccgtcaggaaacagccgatacgccgccaggacatctccatctgtctgcgtcccctggctcccatcgaggagaagaaaaggaacatcaggcagaaggacttggtcaccagcgaatgggtgaacagccccgtatcccgttgcaagttcacgaggatcttgtccactatgccgttggtacaccccagatggtgaaagaacggatagcagaaataataaatgttcatcacgaggaacaggaggctgaccgcgcgcatgaagtcgatggtcttgcccagtcccctggcatcttcttgtgacatgttttccttgttttataagtgatactttgcttatgttttgtctctttggaaacccttttagccgacatgcgggccgcggcgtttccgtttctttttcttcttcccgtagatgccctccgcggtttcctcgcccggataaggacgggattccgtcgagaggatatccaacagcccttccgtaagcccggtttcccctcttgcggtttcctctttcaaggtggtatcctcatggatggctgtcgtgggaagcgtcgtgccgtacagcctgttcaggacggacgcggagaactccctgccaagggccgaacccttgaagaccgtcttcgagtcgtggtcgatgtaggtcaccccatagatcacgcctttttcgttttcccaaagtatggggacgatgcctcttccggccaggagccggaggaatccctgccgggtatcctgccgcaaggcttcccggatggcccccttcgtcctttccggtacgggatgtttcttcatccacgccttgcttcgggcgcatctctttcccagggcctcgtaaccgacgctcctgccgatgtcgctggacttgatgcctacgccgcaacgtctgcctttttcgtcgagtgccgcatagaccagcccgtggcatatccttccatcaatgttcttgcgtacttcctccaccgtcacgttgaacagcccgagcagggccttgaattccttgaacgagcggaaacggtaatcctgcagggccggtttgaccacgtttgcgatctggtgtttcaggtcacctttgcggtagtccaccggtgtcatggtgccggagaccttgcgctcctccttcattgacggaaccagtccgtatttttgttcaagctcccggcagattttcatggaacgttcccattccttgtaatccctgatctttctgccctgctcgtctatgcgcagggagacgatatggatgtggggacgggcgttgtcctcgtgccggaaaatgatgtaaggctggtcgccgtaacccagtttttccatgtattcccgtccgatggcttccagttgcccgtcggagagcctgtcgtcgggatggggattgagtgagaggtggatcaccggtttttccgtccgtcggttggcggcaaggtaggcctcgaagctgcgcatgcattccgggatgccgaccgtgccgtcgggacgttccatgatacggttccatgccagcgtccgggccttgcccttgtccactttctcctggttgtaatagagtgccccgtagacggacacgccggatgttatctttgcaaccattgcccgaactccttggtcagacggatgatctccttgttcagcgagatgtattccacggtcagctgttccagcttgtaaagcagggcgagggctttcttcccggtcagctccccgctgtggacagccttggccacctggttgtagttcacccctacacggcggtagtcgctctgaaggtttgtcagccggatgtagaaatccgtggccgccttgtcgattttcacgaccttgatcggtttgttgaaaatggacgacaggatgaactgcgacttggtcttcgcgccggaattggagtacagcctctcgaactcgatgttctgcctttcatccaggcggaagccgtaataataggaatggagctcggaggagtccttcggcttccggccacctcttcagggctggaaggaggacacatcctgcggtttctgtgtctgcttgattcttgccataggttcttctgtttctttacggttattttttcgggagcaaaataagtgagaattccgctacgcgccaaacggcgcggggtgactatccctgacaggggatgacttttactgacaggggtgtttccccgccgtttcaacgccggtcaatcccgcagttcacgatgtttttctcgtaggtttcccggagtttgggaagcaggacggagaggttctttttcctccgggcgagatcggcacgaaggtcgtagggcttgggcagggtgacattgaaaagggtttcgaatgccgcgaccagggcggcaaaggactggcggtttccctgtccgtccgtcaccagaccggaatagtccagcgaggcgatcagttccatcaggttcacctgggagcctttccaatgaagggcgggatggttccttgtcttttcaccggcaggcggtggcacggcctggagctcgggatggtccgccatgaaatggagcaggtctctctccatcctgacaagggcggcggctttcgtcaggtagatgtccgtcagtccctcaagggtgggatacgcgccatgccggtaggtttccagctccagttccagacggcgcagctgccttagcttcacgatgacgggcagcccgccgtcggttatcgattgcaggcggttcatgaattccgtataggcggatgataattccgcttctgtaagccctttcttttcccggacggctttcgcgaagcagtcgagaagacggtctgtcattgatgtttccataaggtttcaatttaagttttatgttcaatgacaagggaaacgaatgccgtaccagcggatagattttatcaggaaaatattataaaaaacagataatcaatataatatataacaatttgagattgatggtgtaaatgaaaaatgtacaccatccttacaaaattgtaaggtagatgtacattttctgtaagcccctttgaccgccgggtgtcaaccagggaatgtcatttgggaaaccgctcctggaggaacgaactgatttcatccgtattccgcagctctctcagcgaggagacccgccttgcgctttcgttcagatattggatgaacactctgcctgtggacggattgggaagagatataagagcaaaaggtttgccttgacacaataaatgaaaacgggtatccagaaccagcctgcggtagtagatgtttcgctcggttttccggcacaattccctcgttatcggttccagcagcctcatctcaataatccggggaatactgtccgtaacaggaggcttgtgcatggcttgtgcaagaccggtctgccacattcgcttccggtgttcaaaaccgcagatttcaagtctgatcttgctacataagggttggatattcatagtttatgagtaatttgttttcaaacaatttataatcaatcctcttttacggtttacggcaaacataagcacaagacttcggaaaaacaagacaaaagaagttttatcaccaaaagggaacggattgcagagctgtttcataaccttcaaaacaaaaaatcaaatggaaagacatggatattgatgacctgcgatctctttcttcaaaatgggacattcatttttcagactattaaaggaaaaccgatctcttccaattgtttttgtcgttcggtggacatgtttcccttccggtaatcccgcctttggacagtgcaccagcgtcccaatattccttcacgacatccgggccaacgtccctgttggttataaaactggcgtaaccgttcaaaattgctttgccatacttgctctactgaccagacaaatccgatttggtccaacagcgcctgacgatcgggggagatttttccttgcttgcgcattttccgttgggtgcaacaccactctcccaagtttccttctgccgatttcggaaagcgtcggtgcttgttgacgaaaagcttcaatgcttcataatttttcatccattcttcatgcaggtcctggttccagatgaagccgattctatccaaaaaacgaatacgctccttgctcagacatccttttttgcgtctttcccgctgggtatagctccatgtggcaagcgttccgtctttacgcctgggccaacggccgtgcatatcaaagaatttttttaaagcgtggaactccttcatccatttggaatcaagctggttccattcgaagccgatcgattccaacaggcggcaacgttcttcctgcaatctgccccgtttataagccatgcgttgcgtattgcaccacaggccgagtttcccttccgtaaccgacggccagtcattctcttccctgtgaaactccactagccgttcgtacatgatctgccaaggctccagctctgccagtatctcttctatgcgaagccttatgtctgacaggaacccggttgtcaggaaggaagtcgccccttcaaaacctttcggggagggaacatgggaaagacgttcccaatggggggccatcacatcgtagactgattttccggataggttatttacaaaatccaggacaaccggctttttcccggatccggcatccaggcaccgtcccagttgttgcagggtgacaatatacgattccgtccgtctgaggaacaagacggcatccacaccctccacatgcagtccctcgatcagcatgttgaccgagaacagaacgtgcagttgttccgactctttccggaaagcctccagtgtcaggttattctgccgtctgttgttggcatggtggatttcaaacggaacaatggtacgtcccgcccgtgtcagccacccgcatacttcgggtaccatttccctcagatcgccgagatcacggcaaaataccagcaacttgcgtacacttgccggcaggaatcttcggatgagctccgatgcccctaaagcctctttaaagtccacacgtgccagatcgatttttttctgtactccttcttttcgctttttcgagcagtcgctgcgatccagtctcttttgtaaccggttcagttcgttgtccagaccgtaaacactttgcaccaggaccggaatcggcaatatatggtaataccaagcctgcggcaaggtaagctcataaaataagtttccctcgaaatagaggtccaccgtatcgatcattccttccgggcggaccggtgttgccgacgttcctaatacacgggcctgtggattattttcaatcacctcccacaaggcgcctccccagatctcggcaccaaagtgatggaactcatcgatcaggatatggtccgtcttcatcaccttttgattctcccggcaataaatcagtgactgaaatgtccggtagcatatatggggggcgtgaaatccgaccgcctttcggatctcattcaggatcgtgacattcggcgcaagaaccaatatcctctcttccgcatgatctgcaatataacgtgccaacaggtaagactttcctgttccggtcgcctgtgcaaccgccccgatgcggtgttgtccgaatccttttatgacagccctgtatgccgcctcgttatgcgggtaaagctccacatgccttccagacgagaggctctcaatataactttcgtccgaaactgtcagcccgtgcaattcaaaagacagcgcttccgacaggaatcctccgtgcgccacgattcggaaataaggattcccatatcgtttgcccaataaagcaagttccgtataatattgttccgcatccgaccgggtcagaggcagtccgttccagacctcttttacgatggcatgcaccatccccggtctgaaaccgatccataaaaccccgtccgattctgtcacctggaaattaaggaggcgatagcgggttgctaatgaaaggcgcatgtttcctttatctgattgtatttttttggggaaaaatctctggattgcacttccatcaggatgaaaccgattatggcatgtcaggaacggcctttggcttcggcagcatcgtttaactgaactttaacagtatttccacttacaaccaatgtttttcccctgtcaacagataataccgtatttccgtaacttctcatacagggtggtccgactgatgttcagcatcttggcggcccttgcccggttgtttccggcctgttcgagcgtccggagcaacagctgcctctctttttcctcctccgtgagactgggtacctcctcctgttttaaggtcagatccagattcagggaggttgcggtgatccagtccccgtccgtcagcaacagggcgctgcggagagcgttcctcagctcacggatgttgcccggccagggataccgcctcaaagccgcctccgccagccggtcgaatccctgcacccgtttgtggtgctctttcatgaggtggcccagcaggaaacgggccagagggaggatatcctccggacattccgaaaggaggggaacacggatggtgaactcgttcagccggtggaacaggtcctcacggaaacgtcccccggcgatggcctcctccaggttctcgttggtggcggcgatcaggcggatgtcgaagccgcgctcccgggtcgagcctaccggcctgtagcatttctcctgcagggcgcgaagaaggagcatctggtttttgtaggacaggttgcctatctcgtccagaaacaacgtaccgccatcggcctcctgcaacaggccggtcttgtcgctttccgcgccggtgaacgcccctttacggtgaccgaacagttcggaggcggccagatcttccggaagggagccgcagtccaaagtgatgtacggcctattcctcctgcggctctgttcgtgcagctcgagggcaatatgttccttgcccgtaccggatgcgccacggatcaggacggagatgtcagagggcgccaccaggctgatccggcggtacatctcacacgccttgtcgctctctccccgatagaactccgcgccgtcgtgacgtggacggctgaactccttacggatggcttccaggagcttgtccggctggatgggcttgcagaggtagttgaccgctcccaggcgcatggcttccacggcgttctccacctggccgtagttggtcatgatcaggaacggggtgacgatgtggcggtcgtgcatccacctaagcagttccgtgctgttgccgtcaggcaggcggaggtcggccagcacgaggtcgtattccctgtccgagaggctcttccgggcggcggagagggtcgtgacacgctcgccttccatttcctgtttcctcagccagttaccgatgctgcgggcgtatatcacgtcatcttctatgatcagtatcgttttcattcggtaatgtcttgtatttgttccgcgaaggcggccagccggtcggcggcttccgctatgtcgcgtatctgttccagttccttttctgtccacctttccggatccgaggtcgtgatccgtcgcagttcctccagcgggtagtccagccggacggattcccaaaggggcaggttcttgtgcagcacttcccgggcggtccgacggtcgccgctttccagtgcctggctcaggacgcgcaggtctttccggctttccctcgcgaactcgtccagcatctcccggcggttctcctcaccggagaggatcagggagaagtccggattccaggccctgttccccgggatgccgatggtccgcgccacgccttccgagaggctttctatcgtgaacggcttgcggatgcgtcccgcgaaaccgcgcgagaggtattcctcttccttgttcacatgcgccgtcagggcgaccaccggaatgctcctggcctgcgggatgttggacgagcggagcagctccagtacggagaagccgtccatctccggcatctggatgtccatcagcagcacgtcataggcgttttcccgcagacgggcgatgagctcgcgactgtccgtgcaacagtcgcatgaggcgtggcaccggcggagcatctccttcgttataccgagctgcctgatatcgtcatccagcaggaggacgcgcatgttttccaggcggggactgccggtcggccgccggttctccatcagggagttgccgtcggcgggagccaggggaagcagcacggtgaaacggcttcccccacccggcgtgctctccaccccgatttttcctcccatctccgatacgagccgggaggtgatggcgagaccgagtccgaagccggacgcattccgggcgttctccagtcgttcgaacggggcaaatatccgggaggcgtccttcacgtccatgcctatgcccgtgtcctggacgagaaggcggagcttgcctttcctgtattccgcctccaagtggacgctccctttctctgtgaacttgacggcgttcgagagcaggttgttcaccacctgctggaggaatcccttctcgcctccgaccaccacatccaggccggagaagccggtggagaggccgaggtgtttcttcttggcggccagggcatggctgtcggccgtctccccgagcagggtgcccaggtggaagatggagggatgacgctgcagctggccgctgtcaagcaggtagaattccatgagcgtgtcgaccagcgagagcatgtactccgaggcgtgccggatgttgtccacatatctcatcctgtcctgttcaccgctctccttggggagcagctcggccgaaccgcttatcgtggcaaggggcgagcgcaggtcgtgggcgatggagagcatcatgtccttcctggactggaggagctcctgtttctccgtattggaggactccagcctgcgctggtaccggtacttgcgtttcaggtcatgatggacgagcccgtatagcagaagagccagcaaggaaacggatatggcaacaattgacagtgtatgaaatgaccggtcgtgctccgccacgaactgccggtaacggttctctatacgcaggttcgtttccgtttcaagttctttgagaatgctatgcagcctttggttctgcttgacgcttttatcatatagttcatccatttgggacagcaacttctctctttcgtctctctggcgttccgtcacctccctgttcagtgaacggagcatgccggtcgccgatgttttccgttgtttccggtcggaaatttccttctgctttcttcgttgttccaaataggcggattgtttttctttccgccctaacagtcgggaccagaaactcgtagtcccggaaattttccgtaccgtatccttttgggtgaactccgagggagattccgtcgttttttgcacatgggaaacgatagcgggtattttacggttaacgatttcccccacttcctgtaaacggatgaacgtccgcataacagtatcaagcagttgctctttttgttccaacaggatacaaagtgaatccacacgtgatgggcccttcatgaaatgaatatatggtttcaacccttgcaagtgctggcaggcctccttgctctttctttgataggtactgaggtctgcctccttccacactccgacagtctcacccaatgcggacagttccaacaatgcggcgtagatttgttcggccaaatgacgggtatggatcagttcacgctcgtcctgtcgcaaacggtttctttccacctgttccttgcggaaagaataaacagtgaacgctaaaagggtgatcaaagtaatatatcctacaaatatcttaaatcttaaccacatgacttttttgtccggtaaaatggaggcctgtctgtgaccgccattccacatttatgtttttcattatttgttgttgacaaccgcatgtctttataccatcctcattctccattatttatgacaggaatttacgctaggggaaattatggatgatctcccttttccacatattccaagtcgtttccgatattgaccggttccgtggtgcatctgactgtcaccatgcagtcgcaatatgccgcgatacggtgccggtgggtgataaagaggagggtacgcccctgcaaataaacggagagattacggataagccggctctccgtttcgtcatccagagaggaactcagctcatcaaacaaatagacacttcccttgcgtagcagggcccgggcgatggcaatacgttgcgcctggccttcgctgagcccgcctccctgctcgctgcaggatgtgtccagaccttccgccaggtcgaacacgaactctgcggcagccacttccaggacttcacggagttcggattctgtcgcttcggggttacccagcaggaggttctcccggatagtgccgctccataggctgttcccctggggaacgtatatcaggttacagcgtgtggcggaggaaagctccatttccagccccgtcccgttatacaacaggatatgcccttccgtaggacgcaacaaggagagaatcagccggaaaaccgttgtcttcccggcaccggtcttccccaggatggcagtgctggacccgggtctgaaatcatggctgaaccaccttaatatataccgggaacctcccggataatggaaggaaacgttccggaaacggattccaaactttccgggcaacggaagcggagccgggatcgccgctgtcgagtccgtttccagttccctcagacggtctatggaagttgtggtatggataagggaagagaactgccgtcccatctccatgaggggacgctggatatgccccaccagttgcaggaaggcggtcatcatgccgaacgtgaccgttcccgtataaataccgtgtactccccagaggaaagcgatggcgtatccgccagaaaaggcaagctggaccattacgcgggatgcggtggaaaaccggttacgccgcatgaccttgctgtacagttcatcctggatactccccatctgcctttccatccaggacttcttctcgaatgcctgcagcaggaagaggtgctggaagcattcctgcaaaaaagattgcacgcggctgtccccttgccggatggcaagggtcaggcggcggattctttttgccgggagcttgcctaaaagcaggcatgccggcaagaccgtgacaagcagccagaccagccggatatccaaagatgaaaggaagaccaatgccaaggacagctgtatgagcgtcgcggcaaaagaaggcagggagtgccccagcatgttggcgaccacccgcacgtcctctgtcaggcggccttgtatgtctcctgaatggtaacgcaggcggctttcataatccattccggcaagacgggagaatatccggccgcgcaggtagttctgcagccggacgtcgttccttgcggacaggtagcttctcccgtttgagaggatgagttggagaaccacgcagccggccagctgccaggtgtaccgccggaagtcaagggtggaaaccccggaggcgatgtctaccagcgtcttgcatacataaatgaaataaaaggatacgcccgtgtggagcaaccgcagcaggccgcacaggaaaaggctcgctctcgttcctttggaagccgtccataaccaacgggcgtacaggcaaaatgacttcatctgtcttatttatgcgccaaaactcttttaatacttccccggaagtataccaggcctccacgcaggagcatccatggggcgaaagaaaaaatttccatctgccagcggatccagcagtaaaaccaatacagcttgcttccgtaataatttttaggacgtaggctatggtcaaaaaaatagtggccgaaatttccggtttccagtatcagagccattgcacgacgcttctctttcttaccggcagggaagaaatcagggaacatgtctcccgataatcccagatagtctacagcgataccgccgaataaccgccagaatttttccaaccgcaaaaaacggatttcccgtgacagacgctccttgtcgatgtctgccgaacgggcggacaggaaaagagcccagtcgcacacttgtcgcagaccgacaccaccgtggatgaagtgaccaaccaggtggaaaaaaagaaacagggcgtcgaaattcaccggggggagcgatacgtccgttcccttcagtttctcaaagcggcagccatcctcgtgcaggtaagtacgggtcagtcgttggaagcgtttattggtcaggggatcggacaaagtacccgcaaggcggtgtatctcgatgatcaccccgttccgatgaaagtggcgatgtttggaactttcgttttccccgccggtaagcttcccatattttttgagcacctgacaggcttgtccgtactgttccggcccgacataaaggtcaatgtccccgcactgccgttgttcggggcagacgtaatattgcgccacgccttgtcccttcaacagaacgggacagatgccggcacgaaccagtttttcccaaatttcccgcaaaacatgattgagcaggatatgtcccgaacggatttgcagcagttcctgttgcagcggacggaggattggagacggtgggcgcaaggcgggagggagtttgccgataccgtcggcaaggacacccagaacggtctgctttcgtccctgttccaacaggacttgccagtctaccggacgatcaaacagctggagatccgcctccttgtcccacaggccggcccgaagcagcgaaaaaaaacaacgttcctcctcggccttcattccgttatgcctgcctcttgccattccccacaaatgtttacagcgtctgccgatgccagttcccggtctatcccgtaacgttccaccagcaggccggccaataattccggagagaaatcccggttttccaccgccttccacagataggcggccgattcattcagcgtgaccagtttattgaaattgatttgttccagactgtccgctgtcactacatattccccgcacatccggcggagcacgaatcctttcttgatacgcataattagagtatttttgttataatatcctttatttttcactggtacggatcagggccagcaagtagcggcgcacgggtagcaaccgccaccacaggaaagagaggaaacggaaacggggactgtcgcaactcaacgtccgtctccggctgactatccttacaaccttggccacaaccttatccgccgtgcaatgctccgttcccttgagattcccgtcacccatcagaatcaagcgctccccttccttccttatcagacgatggatgacatagtccttttgtgtaatccggcacaaaaggatatcccctgtccggattgcatgagccggaccgagcacgatgccgtcctgtccgccccggatgaacgggcgcatactggaacctttggcttttatttccacagtccggccctcccggacgagatggcgtatttcttctgccaacagcatggcaggcttttctttttttatcattctatggcctttaccgtttgggcgcaaagccgcgcggcggccttgtccggcagacattccaaatgatagctgccacaccgtccaacaatccgctctatcgtgccatgtactccgtccgccatcttcctctcccatggcatgcgcgagcaagaagggagcaaggacgcgtaggcctcgatcgggaccaacgccctgatccgattaagcggggcctgggaaagacgtacgacggcccccagctccgcacgacagttcctgtaacaagccgtcttgccgctccacggcgaaccataaacaaaaacactcccgtcatcctccacacgaaggacgggggagtcgtcgttcaacaggacggaaccctgtacctgttccagccagagacgggcatgggtgctctttccggtaccgctgcgtcccaggaacaaatagcctttgccttcatattccacgcaggcagcatggacaagcagcgtccccttaccggcagtattcaacgcatagagcagcattaggctgctattcagggcaaaagcaatctgcccggacgtgtcttgggtgcggatatgcagctgggcttccctataggacggggatacgaacagcaggcagtccggctcccgccgtgtcatggaaaagccaatggtatggtttccgccattccggtaaagccagagataaggcagggtgtctcctttatagaccggttgccccggcgctttgtcccttagaggcgtgacagtcttctccacacatagggcgaacgccgggtccgcagttccttccgccatcgtcttgaacgggaggtagggtgacagaacctcgtctacgggaaggtcagccggaatctccagcctgaatgggtgtccggcaacggtataggtgtaaaataatctcatgtttatcttcgctcaataaaagacaatccggaaatctcggtatagtcgaggtctccggattgtcgggataaagtctattctatccggccgactataaacaaggtgtcagttggtttgtcaaatcaggactaaccccaatgggactcccggatatttctatttcttgaaagaattttctgcaattcccgtgtctcttgaaagggatgcacgccggattattcctgcgggagtaccgctttgtaaggaatggcactactgtcatcttccgtgttctccacatacgcatgcggtgcgccgtattcatattccgaatcctgtgcgacttcctcgatagcagcgttcatggcagacaagaccgatgaaagggagccgaccgcctggcagtccactatgttcccattttccgcatcggttccgaagaaaggcatcgacgggtcaccacctttcacatagcaggccttgaacgtcggttttatcacatccgctgcatcattcatgtttttcttgatacggtaaactaccgcggcagcctccatctggttggcgtagctggcatagatgtccccatagctttcacccgcaatggctccgccgtaggctcctttcactcttccgcttgcagcgcaggccacgatggtgccgttattcgctcctgcgataccaccgacgtaacgggaatccaactgattgttgctgccggtatctccgctcaccgtcacgtttgccgtacaggctactatctggccggagttgtttgtgccgacgataccgcctatgcgtacttccgacaatatcggctctgccgaaagtacggtaccgcccttcacgtggcagttatggatgataccttccgtgttgccgacaatgccccccacgaacatctgtccggtgattgtcccaccttccaccgtacaattgtccacggcatcattgcgtccgtagctgcgtcctacaatgcctcccacgttttctcctccgttgagagccgggttcgtcacgcggcagttgcggatagacgcttcggtataattgaacttgccctcgttgttcaaccgtccgacgatggtacccacatagccatcatcgcccgtaatgtccgtatctccatgatatgtggaagtaacggtaggcgaatcgaacgagaggctctccacggagccgccttctcccatgactgcgacgaaaccggcaaaccgtgcgtcaccctcacttttgaaattggagatggttttaccgttgccaatgatacggccggtaaacggatgttcgtccgttccgagctgcggccatgagtcggtagcatttgcaaaatcaatgtccgctgtgatatagcatcctaagccatattcgccgccggacacccgttccgcccattcatacagacaatccaggctggtcacggtaaagaggccatcatcagtgagtttgccacattcatccccatcaaaagttgcctcctctatggtgatagcatgcactacattcctgccgaaatcaacaggtccggcttcttgtattgtagccgttctgccttcttcatttaccaatgtcagcgtgtagccttcagtcatattcgtgggagccaatacgaagtaataatttttaccctttatgcaagtctgtccctgtccggcttgatccagatagattgtccctgatgcgttttcattatcaataaccgtagctatcatatcatcctcgtaaagtacgggaatggtcacatctcctgccagcaattcatcgttgttgccgctcaggcgcatggaagagatgtcatcccccgtgtattccggagaaattgtcacacataaatatgcggcggcattataaaatcccaaatcctgcgcatctgcgctcagtgagcgtcccacagccagattcataccggaggcatagcttccgggttcggcatactggtgtgtgtaaaggcgagttgtaaagacaaacgtattctcgtcaaattgagcgtcacggttgtagggatataaggcgcaataccagtctggcgatggttgcgtgacttttcccttgaaattagtcactacgccaccgtctttcgtaatgaaaggattgttcacgttcgccccgtcaatcaggctgatccggtcattggcaacccagaatgtctgcaagccttcgcgtacaagggtccgcgttgttgggccggaaaccatttccccgttcgacgcgctgaaggtcagttcaaccggaccggacggtttttcctcatgctgtatgagttgatctgtgcaggaggtggccccaattaacaggaccacactccataataaaaaggatttcataaaaatacacttaatcataataatcttcatttccatctaaagaatagggatcttcatgatcccaaccagggatgtgtccatcatcaccatctccaggatcagtcaaagaaggtctcaatagcggaccttcgctaaggagttccataactccacacttgggagactcgtaagtctccactttgttgattctttccttcatttttcctttcataaatctgagttttaaatgtttataaatcgatttatagcttatatagaagctgccttttattccaccactgtaaagttgacagactgctcatagccggtcacaccatatttggcattcacgtcataagtgcgtatttccatgcgctccgggaagataccgtacttgttgaccagtatgtcacgtattttttcagcacggttacgggccagccgttggtctgtctttcccgtattgctcacgatcgcgattttcgtatccttataacgcatcatgtaacgtgcgatacggaagatattcaccatctgcagttcctcgttgaactcgttcttgtccggggtgaagaccactgaaggtatcagcaggctgccgaccgtcatgcgttcctgttccacctctatcgtgtcaccggggacaatctgctcctggcgtatcaacgttatggcgttgttcaaggctgcaagctgctctttcgggacgagacgcaccaccttgtagccctgccgcccgatgcggtagctcagaccgatggaaccgttaaggataccagcgaacttgtcacttttacccagttcaccgtcaaaactggaaccggtcagcgcacatcccaccgtcaggtgtgcgcccagccgatcggtgatgttgtagttgccggttacgcccaatcggaaggagaccttcacgttgtcttccatcccatggtacttggcggtgcggagcatgcccacgcccacatatccttgtgaggtccaccggcggtccaggcggttgttggacgtgaagatattgtagaggtcgaacaagaagtccgcattcaactcataatacttcatatcctgcttgtagccgttcttcgtgtccacgcctttactgttccaatattcctgtaccgggtcgaaattgtccacccagccgtcgtgataggcatagatgccggtcgcaccggtgttccatcccttcagccgggaaccgccaaaattcaggcgcacgccgaaatccgggtgtaaccatttacccaccgtcaggctgaatcccggcttcagccgtttgccgaaggggaggctcgcatcatcctcgcccatcaacattcgtccggcaaagtccgcctcaatatagaaattatcccaaaaggaggaggtgtaacgggttttgtaattcacttctatcgtatccatttgcacggtccggttcacttccttttgaggagcctgggcttgtgccgtaagcaggcatccccatgccatcgctattgctgctactatctttttcatatcagtccttgttttcattgtcgattattctcatgaccacaacccggttccagcggtagtcctcgctgtatacccgttcggtatcgcccatagccctgatgaccagccgggaggcatcaatgccacattcttttgtcaggtagtcacgcacggcatccaccctgcgcttgctcagtctcatgttgtaagcgggataggccgtctccttgtcggcaaatcccgccagttccagccgggcttccggatgacgtttcagataacgtgccatacgttcgatattcagcttctggtcatcctcgatattgtacttgtcaatgaagaagcgcacgacaaaggcggtcacgacctcttcctcggtgggctgggtcacttccatcttcgtgggaggctggatgtagcgcactgactcataagtcacggggtgtaccttggcataacgggcaaatttccgcccgccgaacttgtaggagacaccgatgttcagccctgcgtagccttcgacggtgcggttatgcttattagatattccgccaatatggttgtcaaagctctcatccacaatgttcccttggacttctgcaaagacatcccagttcttatgcacgttcacgttcagcatgatgcccgcattgaaagcgaatgaattcgatgccgatgccccccgtgaggcgaacccgtgcgcgaagccgggaccggcagacaatatcagcccgacaggcttcttttctttcgtaaaccaacgcacggcatccgtcatcagattgacggaccagtccatataagtgaacttgcggtgataccaagtaataccgttcttctccgtcaggtacggtttcattccttcgggcatgacggtatggtcatataccgggtcataaatgttatagataatacgcctatcggttaaataatgaccggataacttgccaacccccatctgtacacgaaagccccatacgggagtgaaccatttaccgacattaaaccgcaaggagaattgtgagcggtcaatgaaattgtcatagtcccggttcccttccgcggccaaagaattgactcctccggacaggctgatgaaccagttgcccgttccgctaccggctacgacctggtcggtcgtgtcgccgagttcttccaaaaagtcagagcgcagttccgtatggattgtgtctggcttcaaaacttcctgcgccgcggcacctagaggcagcgtgccaagaagcattccaatcaaaagcacttttttgttcataaattgatagattataaaattattctactgtttcaggttaaccaaatgcacttctattgtctctgttacagtaatatagcggattcagcaacaaaagcgcaaactcatcacaagtctcccgtaccagatacagctctttgatagaagtcttttctccattgcgttgaaaaagcactgaaagaaagtcattccttccagaagtccttaaaacttattggctcagcattggattcaaactctatttcacaggagttgccttgacatgtaaaaacatcatagatgctttttccctctgcattttctactttgattccttctttcaggatatgactgggagatattatgccggaatatttctctacataaatggacagtgactgccctgtatcgtctcgctccatgtaaatgacattatcagctaatgaccttaaactttttgccagtcctgcattcttgtcacacaatataatcaggtcgatgcttttcttttggcagtagttcttgattgcgcttaagaacaaatcatttcccttcaatagaggaaaactataatctattttttgcaggtcatcaatgataatccgctttatctttttgtctgcattcttgtcaaaacagatattcagttgttcgttcaaatagtacaacaactcatccgttgatatgcagcccatattgatattgaaggaatgcatcttggaatagcatttctcacattctgacaatttgcaatggcgcaaacaatttgctgtgcatgaacattccctaatttcattagtataagctatgtacgcagctttttctttctcattatttatgtcatccaaacaagggacagatgggttttctatggaattccatgccggacatatcaaacgcatcctaagattgtcaaccagtctgtcaaaagttaagaacaatgtatggatatcttgtttcgctgcacagaaacagcttcctgccgccaaatagaatttaaaggagtttggagaaccgagtattgcaattatttctccagatgtagtcccatttttatagccaaaaagtttttgcaaggcttctttcaccgtggttgttttcttttttgtataacccaaataaaggtttagaagtacgtccatggccgaattctcagactttttatactcttcatattctttcagctttcccttgttcttgacatcatcaaaaacatttgcatttacatgacgtaaataatggttttctaaaatgccttgttgggtcagaatcttggcttgctgcaaataccttttttgttgcagcagaagatgggaactcggatacacctctattccgtaatctctcttcttgtattcatgccatccgtatgcgcacatttggaacacgctcttgctgatacggagagcatgggatgtataattctccttattgttctccatacgcccaagttcaatcaggatgtccgcacttatctttaacttttcatccaagtcatcaattactataatagtgacaagcgcgctctttctcagtatatgttcaaaaggtgtctgctcataacttctcagatcgctatcgctgatttttgtcaatccgtctatgacaaggcaggaagaaggcatcaatttgttcttggagttctcttctgcccctttttgtatatgtgaaaggattttgctgaatgtgtgagaaggagttgtcacgtatttatattccatttcatttctggaatcttcattttctacaggaatatgtccattgaatcgaacatcaaaaaagtcattcctgaaatcgaagttcccatcagacgagaatacatttgaaattttctgataatcagaaatcttatcatacttgcgggtaaacagtatatttgcctgcgaatctatggactgggctgtcctgaaatgcaatgaattagtccggatattgtaatatacgatgccttcggatatatatgaatctatcttgcttttcaaattttcaggaaatggcggtggagtattggaatgcgatactcccgcacggattttgtccgtatcaaatatcgcatcggcaaaccagctgtccgtccagtcattgcttaagctgcttgtcctgaccatcttgtcaatacacttggaaataataaagtccaaaagcatatcgttcatctggtctgtgttcttgtccaatgaatagaatgcgggaacttgcggtttaaattccagattgctcaatgatttggcaataccatgcatcatttgcatcgctaacaaggttttgtctgtgccccggtctcctttcaagactatgataatacctttctcggaagatgaaatatcttcttccggatttatcaatggcaactggagaccgccaagcagcattttgtccagtcctttaatccccgtcgaaatctttccgaccgtgtttattccttgtcccataatacattaaatatatgattatacagttctttgtaccctccgagttcaaatatgggggtcagaccataattagtaaaaaatgcatctttgatttccattatctggacataacttttataatcctctgactgggtctctttcaaatagttctttgtggaggcatgtaggaaataaatattatcctcgtttccaatcgaactggcataatgcaccattctttgtgggttgatgtcactcaatgaaattcctacaaatacgcaggtgaaatggcatagaaaatgcaattgggtagcggtttgccaagaatagacattgcgaacattgtcataatactcttccatcgaaaggacgatttcattcccatcgctcagaaacggctcgttgaaagggggcaggtaaccatggatatggtataccggcaggatattgtctgcttgttgagaattattaaaattaccatatacttcctcaatcctgactccgtttttccatcgtttgttcgccattaacatgtcttgttccttatcagaaaaaaatttgtctttattctcatacaggacttcaacggccatggtaaggaatttatcataattataagttacaacagccacaagaggctcgtacagtaaaatgagccgggcaagctggtataaagaattcaaggaaggagcatcttcttttaattcttttccatggccataatactctaaaaagatttcagtcatcttgttcttatcgcaataccggtacaattgatggcgaatcgtatggatataatttttacccaaaatagatttgatgatggaagctcgcaccaaggacgtaaattccccttcaacggtagtgtgtaatgtttcccaaagggattgctcttcttcgcttcttagaccgattctacgagaggaacatagcaggctttccagacgttccctctctttagtggtatatcttttctcggcagacaatacggataaagcatctttgatcatcatgttcaacaacccgttccaactgatgtcaatgctactgtcgccccctaaattgattccggcacctacaaacaatacaatcttttttctgtcctttatatcctgtcttaaggcttcgatattcgcctgataagtatcgtgttcgaatatcaggtgtttggatttatctatctgtcgttccatatccattcaaaatgttctatatccgattctacaagtagatctcctgactgtacctcgatgagtgtcaagtcggagatagccctgaggcatattgaataccttttttgaccggaaccgtatcgcctctgccgacttctgaccggattccgtcaaataccagttcctcctccccgtcaatgaatgtccaaacttcatcgcaatggcggtgtacctgatagcttatacacttactggatttgattttcaattgcttggtaaaggatttataaccgtcaggaaactcctctgtatctaacactttatatttgtccagcgacattcctcgaccacaggcgtttatccgaaccgctggatatatgatttgcatagatgctattttgtatgcgatgtgtagggtatcagcggactcggcaaggtcgacaaggtctatctcggcaatcccaatatggtttacgccctttccgacaccacgcccgatattggcaacctgcgcgagacattcttctatgcgctgactcgtgtcacccatgttcccttgtcatcgcgctggtcggacttcacgataggcaactacacattcgaggtaggcggcaagaacaaagggacgaaacaaatcagcggacagccaaacgcctacatcgagaaagacgatatcgagaccgtcggactgaccacgcttgctctttggacttttggcatgatgattaagcagatctcctctgaaaagaataattatcaaatccgtcccatctcaaccaaccacaagaatcgcaagagatgaatttgtcgtttgatacgggaaggttgcttaatcaaccgataggcgaattccaaattatgatcgacccaccatttaggcgctcgttttacatgccccgtataaacatcaaaacttccacccaaaccttgataaatcgctggatgccgttttgccatctcctccatcagcaattcctgctttggcgagcccatcgccacaaaaaccacattcggtttcttggtggcgatatcgtccaacaaagcctgtcgctcctcatccgatcggatataaccattccgataattcacgatatgaattccgggaaactcttttcttaacttagcgacggtagcctcgataacggtttgtttacttcctaccaaataaaaacttctcttttgaggcgacaaggcagccaccaacttcagccacaattcacatccggctattttaaccacctcaccatgcccccgttttttcatggctaaaaccgctcccgaaccatcacaataacctatattccggttaatgatctcccgggtctgatcagtcgcatgcaggattttttcggcattaatggctaccaggattcccttttccctctccacatgcgttaaaagttgatcgaacgaggtaaagggataaaccttcactccgttcaaaattacacgattatctttcattccatcttattttattccttaccacgattctatcctaaccgataaagcaacgcgttcacgatccgcccacaggcctcaccatccccataaggattgaccgcctgactcattgctgcatacgcttgcgggtcgtcaagtaattgggagaccccgctcacaatcttatcgtaatcagtcccgaccagtttcaccgtccctgcgtcaagcgcttccggtcgctctgtcgtatcacgcatcaccagaaccggtttgcccaatcccggcgcctcctcctgaatacctccactatcggtcaagacaatcgtcgatttctccatcagataaacaaaactcaaatatctcaacggctcaataaaaaataaattctcaaagcgtgacagatcctctccgaagacctcatgaataggcctgcgcacattggggttcaagtgcatcggatagacaaaatccacattcggataccgattcgccaaatcccggatagccgtgcacatatgaatgaacccttcgccaaaattctcacgccggtgtccggtaatcaagaccaaccgtcgttctccggccaaacgatcaacgtcatatcccgcctcttttaagatatgagccaattgggcatccagtgtttggtcttgcttaatcttatcgaccacccaatagagcgcgtcgatcaccgtattccccgtcatcaggatctgctggtccgggatcgcttcccgcatcaggttcttccggctcaaaggggtaggcgcgaaatgaaacgaggcgatccttcccgtgatcaggcggttcatctcttccggccaaggactatataggttgtgcgtacgcaaccccgcctccacgtgccccacaggaatctgttgataaaatgcggctagagcagcggcggtcgatgtcgtcgtatcgccatgcaccaagacgacatcgggtttaacttctttcagcacatcacgcatacccaataggacatgcgaagtcacgtcatagagatcctgccccgccttcatgatgttcagatcaaaatcgggtttgatctcaaacagatccaacacctgatccagcatctgccgatgctggccggtaacgcaaacaacggtttcgatccgatccgattgctcctgaaatttcttgactaaaggagccattttgatggcttcgggacgtgtcccgaaaacaagcatgatttttttcattaaaacgtctgatttatatgtctatttaatagatagcaagagattgcgtgaaacataaaagcattgctccaacgcatatacgaaatcttagagctgatgcccgatttcagctgataataaaaatagcccttcttatcctgcatatttcggatcgtccaatccagcaccttatccgctaaagaaccatacgcatccatcttatgcaaacgcgaaagggtgatcaacaactgacccggacaatggatgtcaatcggataggtccggttgtcgtaatatttaggtgctccatcgggcttgaagaaattttcgatataatagttaaaacctttttcaatatacgcttgatactttttgtcacctgtcaattcctgataagcaatcaaagcgtctagattgtaacctgtatggaaactatccacccaactttggataggcagcatcccatagacccaagcgccatcacttcgttgcccagcgcaacacgccttgatcgactgttccgccagcagggcatattcttcttttttcgaataatgatagcaatagctcaaaagccttgcgcctaacaatgaggcattaaatacggtatcattaccgggcaaaggactataagaaaaaatacaaccatcttgatacggcgtgcgatgcaaatccttcgttataaaatcggcggcagatagagccacgtccagatacttccggtcgttcgttatctcgtatgcctccatcaaggccgtagcacaaaagtttgtggccactaccgtaggcgtatatttcgggaaaaaaaatagtcgccttgcctgccaatcaaagttatatccccagcaagcaccgctgtatcctttcgattgaagatgaatcaacaattcggccagtttattgatccgatcttttatctctatttcagcacctaacttatccgaccattcaggatgtttctggacaatttgataaaggttgcaatatcctgaaagaaacaacccgatccccttggcattgtattctttcggtacaaaagccagctttcgtaaattaataggagaccgcttgaaaccttgtatcattatcaagcgacaaagtgcagatttcttcaaaaatgggagtgcttgaaatactttcgagttaagaccatcgtatgggtcccaacctttaaagtgttcttgttcgcagtaagatttgagcttgcaaaaagatagaatagtcttgtccattgtttgtaagttatacttttttcttttctgtcatatacggcattgttccctctttgaattttggattggtttctatgtcatattccaaattacttctccaaccgattattttagccggacatccaccaacaatagctcctttggggatactcttgtcaacaaatgagtttccggcaattacgacatcgtcttctataatcacgggacctgcgacaacgacattcggacctatccatacgttatttcctatcttaggaacatctttataaggaaactttctgacagtagaaaatcttaatcccaagacacaattattccctatttgtgtcccaggtattaaaacggtagctatgcctttgcagacgaaatacgttcctttacctatagatgaatcacccgtgattttggtattataaaagaggaagataaataattgtatgagttttggtagtaaggggatgtggtgtaaatagcaccaacgcataatacgatataaagaaacagcattagccataatgatattttttaatctctttttctgataaatcgagcaggattaccggcccacacttctccggcagggatgtcttttgttacaatcgagcccgcacctatgatggcaccttctccgatatttacgggttttaccaccaatgtacacatacctaagtatgctcctttgcagatatgcacttgacctctatcgtaaccgcctgtttttggattcatgaagtgggttactattcttactccggcagttaagcggacaccttcttcaatgataatatcttctgggtaattagtgtcaaaagtaactccctctccaatgaaagtctttttatgattttttatagatacccccccattttaacaaaccatggtctccatcctcttgatctcataggtaagtgctgtagatggaggaaaaccaactttcttaaacgagataatttcataaaacgctttttattaaatgttcttcgattctttgtgcgacttttgaggccataaaatgatctttggcatattggtggttgtattgcgacacttctttggttagctttttgtcttgaatgtatttttccattagctgtgcaaagtcctttgcatctaagctgtcggtaacttctcccattctaccattgatgaaaaaatctttcgtaccccctaccggtcggctgatgacaggaagaccaaaggccagtgcttccaatatactggttggcattccttcgttatgataggtaggaaataaatatatatcggaagtcgtaaattcggaaataagtttatcgcccgaaagagtgcctaagaacgttacacgttctatcgcttcgttcttacatttctctattgcctgttcgagtgcagggccatttcctaccactcggagttgtaaatctgaatattttgtagcaagtttcttaaaggcatcaagggcgataaagattcctttgctttcggtgatacgagccaagaatagtatcgtgttgaccttaccggttcttttctcgatatcaaaattggcaataagtttatcatccacttttgtcgttgcgagatagataggcacattcactccccacgaagagacagtatccttaaattcttccgccaagacaaagatacagactgttctgttgagctgttttgtcagtttctttatattgatatgattgatgctgtggtagtcgaagccatgaaaaaagacggcaacacgtttcttaaagaagcatgctattcgtaagaagatgacatcacgcacaacagcagaacgagatagtgagggatttaagagtactacgtccggtttgaaggtgaacagcaaatatataaattttataatgttgataggcagacggaaaacaccacttccagacttggaattacgctttcctatggggttatataatacatcttcagaccagtattcttttaaacctaaatagtgattggctactccaccatgtggtatcaatcgaggtgtgttgataagtattttcattataatatagttaaatattttgcaaaaagaaaaatttatacactaccggggaatctttaacattcgacaagataagtttcatgtgactcgttatctgataagagaatgttagcacaaaaaagagtgctgattggaacgatagtttttgtgtcttgacaaaatataaggatgcataggcaatcattggcagcctaaaggtcgtgagatacatcaaaggtcgtgtgaaaatgacacccgaatacactaataattcacggagacatattccccaaaaaaacaggaaaaagcacacagaaagcattttgtcttctttgaagtaggattttatgtcgtcataagaccatagaataaacatattggaaaaaagtatagataatcgtaccggtccccatgacatatctcttgtttggtcaagaagaccatccacgttctcggaataactttgatagtctaaaaactggaaaattgattcagtatgtgatagaatattggtgacaattggatttgtgcctaaaataatgcaaacaagaagtaataaaatacgggtatttctttttggaacaggaagatttctatgtagtaaaaagtatagaggtagcaatagccaaacagatttgtgtatggaactacagataaaaatgccaatgaaatatggaataaacttccgctgttgaatatattgtaatagaaaaaggaatgtacagcatacaaccgtttgtcttactccattcatccattcaccccaaaaaggagtaagcataatagctaagcatagatagggataaagttctctattgttcttaaaagcataaaaaacaaagaatatctgtaagaatgcccaaagagcaaagaaaaagaagaaatggagattacaatcggcaactaattgtagtacatgcacaaatccccattccaaggaccttcttgaaatatatccgttctctttatattccgtaaaaaatcttaaataagtaccatggtcagctcctgtatgaaatcttgctcctgctaagaatacgaaaataaagacaatagctgcaatttcccaatgccaaaatctctcttcgcggttaaggatacagcaccgttcccttttgacgagattgtcagccaaaagatacataatcaggctggtgaacgtatatataatcaggctaaaaaagatcataataaatctaagataggtatgagctgtctgttgataatgttactccactgatatttgctcaatgattctcgtatatcagtttcttttatgtctcgaactgagttggctatttgttttaatgcgagtgtaaagtcttcagtagaatcatctataagtataccattggtgctgtttatcaattctttatttgccgcagtagctgtagcgatggtgtatagaccggacatgacgtattcaaatgtttttgtcgggggttgatactcgtaatagtcggtcataggtacaaatgatacacctacattgcatgtgtcgaagaatgcttttaactcggtatatgcttttctgccatgaaattttattctgtcttctacgccatgttctttacagattgattgtaagtattctaattcgttgtttgctccgtctccaataatatcgtaagtcaattgtgaggttgggttttgcttcagaaattcgataactccatatacggttttatgtatatcacgtccattaaaagtgcctacatacaagaggtggagagttgaataatcttttttttcatcagatatacaatcagcccccaatggtagtatggaaattactttctcttgtggtagcgatagagctttttttacaccttcggatatggcggtaatcacatcgtatttcaggcaggtctctttcagaatttgattaaaattgttacgttggttgctgtctcgtgagatagaaagcgtgcgaatatctaacagcatttttttcttgggaaagagttttttgtaaatactgcatccttcgaaatagacaaccattattttcccgttgaagaatgtgatatgaaagagggtatacaaaacatatattatcccgcggagtattttaggcatcctcgagttcacatattttacatcgatgtcatccgtcggtattttctttgcttgggtgtcaaagcagattaacgtaatatcgtattcttctttaagatattgacaccatttatagcaatccgttaaatacccgaattgatgcttgtctatgagtaatagtttcttttttatttgcatatgttcttcaatgaactaaatagtcatatatggcttttatattgttctcaatagagtggttagctgctgcatagcgatatgctctttcttgcatttcactcatttttttgcggtcatcaatcaatccttctatttgtttggctaattgtgcaatgtcaggatttatataacctatttgtttatcggtaatgatattgtccggattggagttggtggcaaggacgatacactttctcatccaagcctgtacataagtatttgaaaatccctcgtattcactggtgttgacaagtatatcggatttttcaagtaattcgaatacttcttcttgttttaggaaaccgacgaatttgaagtatgtacactctttttcggtagatctcacagtgtcttcatacaatgtattgggtatccctatcattctcatctcgattttgttcgcatattcttttagtaaatgcgctaattccaagaatagttcaggtcgtttgataggttttaggttggctatccaaacaattcttattttgtctttggcttcaagtttgtttttgtccgacatgtctacatagggtgtcatttgccttacgagtatcccttttttaccaaatcgactcttcatcatatctcgttgatatgagttctgaaagataaatcgttctccaagttttagccctttgttgatgtaaaaagcctctatgcaaccaatgagtgatttgtttccccggaatagatgcatatcagcacatttgtccgaagcaaatgcatgaatatgtttgatagaatgtttttgtgcgtatttttcggctatataaatccatgaagatgtactttttgtatagatataatgtggatttatttcgtctaatacttttgttatttcatattcatatggggcatataatcttctttttgttataagtctattttttagaggatgtaagttgattttatccgtgttctttattggagcgccaaaatcgatataaatgaaatgtatgtcaaatatatctctccaatatttgactatatacctgatttgaagttcggcaccacctgtgccttgttcgtaatgacatggatacacaatagcgagtttctttttcattgtataattgtattataaagctatttgcttcattgtatgtatatttacatcaatccctgtgttttttataaaattatgtctgatgacatttcccatttcttttcttttaaaaagtggtgtatcaatcatcaatgttatggctcttgatagggattgactatctttggctggaactataaaatcgttatatacaccatctgtacccataatatcgggaactgccccaactttatctgtcaatatcaaaggtaaactcatagaagctgcttcgcatgctacggtagaaaaaccatcgaagtgtgaggggttaataaagaagtctaattgactatagacatatggtaggctttcggagtcaacccagtttagcaccctaatgttttggttttctttagatttttggattagaaattctgataaaggaccgcgtccaacaaagtagagcatacttttcttttgatgctcttgatctaaattttcgaaagcttctaataatgtaagtactcctttgggttctgtttgacgacctatataggcgtattttacttcaacaccagatggaacgtcctcaaaactttttcttaattcttctgatgcgactatcgctttagtcgataaatcgactgaagacattggccataaatggcatttctcgggtgatataccttttgataccataaattgggtagaagcaataccttcattcaaaacatagtccgctttttttacggcattcatcgacattttatcataaagtcggctgaaaagcgtttgttttttatggttatatgaccaagcttcatttacataggcgagctcgtacttaaagaatggttgaaggaagctaacaaccttagcataaaatggatgttgggtggatgaaataactaagtcataatgaccgtttttcagttctttatatatagaatgtatgagctgaggtatttcttttaactttaaccccgagagtctaaaatgggtgtatttccatgtttcggtttttaccttgcgtagatactcttctgttgcaataccgtttattcgagatgaggcttcaataaacttaatgtcaaactgttccgaaagagctataaataatgcttccctagcatgaaaataaccgggcgataggtataatatctttttcatatcgatttttaaaagattgcttttctaagatattctgcggattcttctctaaatttgtttatgttttctctgatttttatgaagtcgcatgataattcaaaatcatccttgctattatattcaatcattctatcatcagctcctaccatttgtagcaaacttgacatccttgagtcaaaaccacctctgtctttaatcactgaaataaagggagtctctaaatttaggcaaaaggctgttccgtgaaatgatgtggtgacaacaaatttggcttgactaatgagagaaataaattctaaaggaccagcgtcatcaattatttcgaagttctttaagtttcctgtcgttttggggcgatcgagaaatatgattttcatgttgtttaatttttgttgaaccttattcaatatatcattaacatagggatatgggtcgtatgcatactttagaatatatgctagaataaacgattcgttatttttattgtagatgctatcacttatcagttttaagtaatctgttttatcaagtagcaaggtaggatcacagactacagaagcattctctctaattagttcttttactacgcttacaccgctttgctctcttactgatatggcagcaaattgctttaagtatttcgcatataaatccttaaatttatcggggattgtatcggttgcaaaacttgatgaatatgatattttttttgcattttgaggagcaaaagacagaaaaaaactgacatcatcattgatgttaataggattccaaatttggtcgctaccagcaacgaaaacattaaagtttaagttggcatctgacaattcttgtggtgaatggtaacattgtggtgtaaggttgtagtattttttatagaaatgcttaaaacggtctcttttcttcttatttgagaaaccggtgtatatctctttaataaaatttctaagcaccgactttagtgttactttaggaggagttgggaactgataatcaattatagtcccattaacaccgatgttgtttaatttttgcaatagagcatacgattgaagcgctgaaccaaaattcagtactttgtgcattgttataattccgaccgttgtctttctcatttcttttgtttggtttatagtttattgataactcttgaaaacagatcaatccatttaagtttcagcggtgaagatagagccttggagacaaatttgtgactgcgtgggcgcttgggagcatctctcatttgacctcctaatacgatgtcaatttcttctttttcaagttgaacgttagataatgagggtagaagctctttccctttttgggttagagataacacagcactgaccccttcgttgttgtttgcgaatttgttgccccataaatctcctattcgaatatcagccgaagagttgagtaatttgtatttacaattatcataacaggctttattcaaacatgcgtgaccaaaaaacaatcggtaaaataagtcaccattcgattttttagagttatagcattttatcatctctttgctattatatttcagctcaattacccatgagtcgtgccatcccgtttttttgtttctccatgatgccgttagcggtgtgccatacttctgtttaaattcttcaatatatttatcccaaaccaacttagatggagtaccatggcaaaagaaatcaactaaaataaaattgtcttctgctttcttgagttggatgagtcttcgcaacgaatctatttggcatggtgtcccgatgactaagtgtttttgcttaaaatcgatttccttaaaaccgtttaatgtatagctttgtatgtattttgacccaattgagtctgttaattcttcaattgtatgtgcgatatagtgctctgctttttgctcctctccgttatagcgaactgcacatacattatatcctgcatcaatagcttgtttacttatttcgtatgctattccacccgatgaacacctatgtcttatgtcatcatctaagctccaagctgcatatgcttcttttttactgtcgtttttgctttgcatgtgttgtgtataattgaacgcacatgcttttacgcaaacttcacaatcagtacatttgtttgtgtctataatcgtgggacgataaaaaccttgtttatcttgtatcatattgattatgtgtcgaggacatgaaatagcacaaactccgcaaccataacaggagtcttcgaattttaatacgttcatatacgttatttaattatacatatatcttccttgttaattgaacctgtggaaaataatatgatgacaacttcattttattttaaggcctcgttaagaaattcttctaatccgttgtatttggccttgtggttatctaaccaataattataagcgtctcctaattgtcttttgatagggatttcagtgtattgcgctatgttatgggcatcaacaaatagagggaactcttcccaaaaatcggaagcaacaggcattcttccgtatacttttttgatactttgggcatattcgatagcctctttttcgtatacttccaatcgtttatggtaatagtcatccataccgcaaatgactttggctgggacacctcctgctatacaatttgcaggaatacttttagtgacaaccgaaccggctgcaataaatgtgttgtctccaatagtcactccttttaatattgtacaattcacgccaaaacacacattgttaccaatggttacttttccggaagatggaataaaatctttgtacttgtgcaaaaatatagcagatacataatcatgtgtaaacaatttgaaattgttgttcagttggacgttattaccaatctgaattagggaaggtctggttgtgtctatgttgattgttttacaaccactgtgaagaattaaattttccccaatagcacatcctagacttctaagatattttatatatgcttgtgacgatcttttgctttgcctgcgctttattatatttattattcttttaatcatttcttttctttactttttttgttattgtaataaggtgctgtttgaagtattgatatgttttgtctgatgtcaattcgcaaatggcaataaatactacgataaagcacactgcccagatgcatgtagatatgataatgtccaaattagtcaatcgtacgactataccactaatcactaaagacaaagccggtttccatgcaattttcagccatatttttatctgttttgatagcgtaaattcgatggtgcgtccacaatagtgcatataaaatagcgcaccgataaagttggctattatttgaccgataataatccaagtaatggagaatggggcactgacaataagagctatgatgatgagagcgttttgtacaatgcttaggttgcgataaatatccgacctgctttgcattttcacgatgttgttgtttattgtaactaatgggaatgtgagtgcaataatcataaataaatgaaatagaggcacagaaggcatccacttgtttcctaagagaatataaaaaacagcttctccgattccgatcaaaactgctactaacaacgtttgtataaaattgaaccgcttaaatagctcgacatacatgttgtatcttttatttgcatctttttctttcgctataataggatagcttgttgacagcatcactccatttatcccctttgtggggacaatctgcattttatgagcttggttgtaataacccaaactggttgctgaataatacttgccgataataatggagtaggcgtttgtccctatggtggtgataatgtatgaaaaaagcaaattggagctaaaggcaaacatttccttgaatcgaattcgatcaaagcagaaatatggttgccaatgcccaatagtaaggagaaaaaacaaattgaataccgcaataaccaatggttgtatagctaatgcccaatatcccattccgcaaagagccatagtgtatgtgaccatgattgatcctaccgagcataatagattgattgtcgtgtttgttttgaatcgcagttctttggttaggcgtacgaagccggtcattgttaaggatttcagaacaatggaaaaggctaatactcgggctacgagaaccaggcgtggctcgttgtaaaaatctgctataagaggcgaacataagaagataataagatacatgagactgcctatacaaatgttgtatgtagcgactgtaccaaaatccttgttatcgctatcacgttcttttataagataatcattaaaaccagccgaggtaaaacttagagctaactgtgtgataattgccaacatagcaactaacccataatcgtcaggacacagaatgcgggcaataaggatattccctataaacccaagaatctctacaccaaatgttccgacactcgaccatatataatatttgatattggacatcttaatttgctaatctgctttttagtatttttgcaggaacaccccctacaacagagtaagggggtacgtccttattaaccaccgcaccggctgcaacaacagaacctttccctatagtgactccatctaaaatggaagaatttgttgcaatccacacgtcatcttcgataactatacctttagaggtactaccttgtgactttattgttttatttggatctgcgaaaacgtgattcgcacctattattaccacattgggagcaattgacacattggctcctattttaacctgaaagagaatgttggtatttctattaatagtggtattatcaccaattgaaatagaaaacatattggctctaatcaaaacattttcatgaataaaaacattatttccaattttcacccttcctcttatctcggagttatccatcaagtggcaaccttttccaattgaatttaattttagtccagagattgaagcgttcttacctatatagaagtatttgaatgatccaaatacgagaaaaagaatatatgtaactcttcaactcataaaaaaatctatttattctatttaatactcttactatattatgttatggttcataatctatatttaatttttcataatctaccatcaaccaaatccttcgtcataaatccttttacgtcatatatcacatggcgttctttcagtaaactgtctatgttaagttcactgaattcgttatgtgccacagccatgatggcagagtcgaatttggcagttggtaactcgtttacgatgtcaatgccgtattcgcatttggcgatgtcaggatttgcccacggatcatacacagtaatatttacgttgtactcttgtagtgttcggtaaatatcaataaccttggtatttctaacatccgggcaattttctttgaaggtgaaacctaaaagcaagatgttagaattcaagacttgtattccttttttcagcatgagcttcactacttcgttggcaacgtattctcccataccatcattcatgcgacgaccggctaagatgatttccgggttgtagccgtgacgttgtgcacattgtgccaaatagtaaggatctatgccaatacagtgtcctcctaccaatcccggtttgaatggtaagaaattccattttgtggatgctgcttccaatacatcgtgtgtatcaatacccattttggcaaatatcttcgataattcgtttacaaaagcgatgttgatatcccgttgtgagttttcgatgactttggcagcttctgccactttcatggttggagctaaatgcgttccggctgtaataaccgaggcatatatttcatttactatgcgaccaatctctggggtagagcctgaggtgactttctttattttttctacggtgtgaagtttatctccagggttgatacgttcaggactataaccggcgaagaaatctacattgaatttcagtcctgataccttttctacaaccgggatacattcatcttcggtcactccgggatatacggtcgattcgtaaacaacaatatctcctttagaaataaccttaccgacggttgtgctggcaccgtaaagaggtgtaagatcaggggtattgttttcgtctaccggtgtcggtacggcgaccacataaaaattgcagtctctgatgtcttcaatgttggcagtacatctaaatccgtttgcaatagctgactgtaagagttcgtcagacacttcaagagtcgcatcgtgtcctgccatcagtgcttcgacacgttttggattcatgtcgaatcctatggtcttatatttagttgaaaacagacgggccaagggtaaacctacataaccaagtccgattacacaaatctttgtttccatattgtttgtttttttgacgtcgttttataaatttgctttgtaccattctattgcggcagcaataccacgttcgaaactccaatcgggattataccctaatagctgctttgctttgctgatatcggcattggaatgtttgatgtcgccgggtctgtcttgaccgaattccggttctgcttctatacctaatgatttagtcaatccataatagatatcaatcaagaattcacgacctccataggcaatgttaaatgcttgtcccgctgcagaagaaggggctaaacatgctttcaggttggcttctattacattttctatataggtgaaatcgcgactttgctttccatctccgttgattttgcatttttctccatgtagcaactgctttatgaacttgggaataaccgcagcatatgcaccatttgggtcttgacggcgtccgaaaacattgaagtatctcattccataggtgtcaagtccatagtgtttggtgtattgtttagcccattcttcatcgcatcgtttggatacagcatatggggagagcagattaccttctattccttcctttttaggaagattgggctcgtcgccatatacagaactcgaagacgcatatacaaatttcttcacgtgattttgtcgtgcggcttcaagcatatttaatgtcccttcaatattatttaaggaataaaaaaggggcatttctatggagcgaggcacactgccccaagctgcttgatggagtacatagtccacatctttacatgcttttatgcatgtgtcaagatcctttacatctcctttgacaaactcatagttaggattgtttataaacaaatctatattagattgttttccagtactcaaatcatccaaacaacgaaccttataaccaagattcagaattgcttcacataggttagaaccgataaaaccggctcctccagtaacgagaaacattgagttttgtgggaatgtgatatttttataagacatatattttatctttatactatctacttttcttctttacttcttaaatatcccgcagaagtccagtatcactttgtcttcgcgccaggggagttctttgaaggaggtatgggcggtgaggaaaaccacgatatccgccttctcataggcttcccgataatcggtcaatttgaacacattgtgttctttcacattaggttctacgacaaggatatcggcattgttacagctttgcatcaccttagtcgtgatgtatttcgccggcgactctcgcaaatcgtcgatattgggcttaaaagccagtcccatcatcgccacacagggtttccggtgatgttccaactcaaaacgtagcatggtgttttgcaccttctccgcacaccaaaaggccttatagttattgatttcacgcgctcttgcgatcaattgggactcgaccggaaaatcggcggtaatgaaatagggatcgaccgcaatacaatgccctccaacaccacagccgggttgcaggatattgacccgcggatgtttgttcgccaaattgatcaattcccaaacattgatgcccgccttgtcacaaatcaacgataactcatttgcgaatgcgatctgtacatcacgcgaggagttttctgtcaatttacacatctcagcggtcttacaattggtccgatgcaaggtgccctgcacgaactggctatagaattcgatggccttgtcggttgaagcctcatccatacctccgatcacccggtcgttgtgaaccaattcatagatgacgtttcccggcaggacccgctccggacaataggcgatgtatattttacctttcaactccggccgctcatgaaagatcagcgctgccattttatcggttgttccaacgggtgaggtagattcaatcacataaaggtcgcccgccttcaaatggggcaataccgaccgggttgccgcctccacataagagatatccggttcatgattccccttaaatggggtgggtaccaccataaagtaggcatcgcttacttccggttttgcggaggccttcaaggctcccgaactaaccacctcccgcaacagctcttccatccccggctcaataatgtgcaaacaaccttgattggtcatctccaccactttcggattaatatcgactcctgttacttgaacgccatgccgagcggcaataattgcggttggaagaccaatatagcccaaccccataaaacatgcttttttcatcttgtatgttaaattagtttgttaagtaaagaccgcacacattgcaaacatcataaccgggattcgatcggtatatactatatcggcggtttgtcgaccgacagaaagcctgttgacacccagacggtagcacagtacatagacctacaaaaaacgctggaaaggttgcataggaaatatccaaaagcactgattgtgagacaccaagacttggttccccggaaagattgcccgtgcttctatgtcgtaaatgaatatgctttataacttgagtttcaatcaaacttaaatcagcttacagacggctcgttctgccaggtgatcagtacttttgaataatctggcagaaatcgagctgtttctgtatattccctgtaacgctcgtacagatgaacttttgaaatatatcataactatgaatgtctgtcccgatataagcaacagtcttattgcttaacagcatcatggcctttttcttaatccggtcaccatacatacccattattgacgggagattgagctgaaacttcactcccatatctttcagttgccggtaatcttctttctccatataattgtaccgctccggatgggcaagaaccggatagtaacctttggccttgatgcggagcaggatattgttcaatcccatgggaggattgaaataggaggtctctaccagcagatgcttcccgtcgctccctaatggaagcaggtcgttctttcccaaccgttcctcgaaaagattgtcgagcatgttttcggcggcaagatgcagaattaccggaccggtgtaaacggcttgcagttccgcgaaacgctcccggaggtgagccgtggtattggggatttcttccatgatgtggggagtgagccaaacttcccgaatacctaaccgctcgtattccgcaaggatttgcagggcttcttccaccgtctgtaccccatcatctacaccgggcaggatatggctgtgccagtctgtgaatccttgcaagatgccgctttcctgcaaggagtatctttttttgaagggccacatcgccttactttttatctgtatcgtacggataaccgtaaccatagccataatggtaaccatagcgataaccgtacttgtaactcccactattcacttccgtaccattgagcaccagtgccatatttttgaatttcttttccttgtaaaaaaattccagttcgttcagcatggaacgttccaacaaaccggtacgaacaacaaacagcattcgatccgcttgcgactctataatttgcgtgtcggccactaattccaccggtggacagtctatcagaatgtaatcaaattctttgcggaaactatttatcactgtgacgaatcgttccgttgcaagcaattctgtcgggttgggagggatggtacctgtcggcagaatgaacaggttcgcataatccggaaccggccggatgatttcatccaattgtcccaaccgctctcctaaataatcactcaaaccttttttcggtgaaccgacataggctgacgtacttccatgccgcaagtctccgtcaataaccagtatccgttttcctttaatggccaggctggctgcaaagttcattgtcaggaacgtctttccactaccgggattgaacgaactcaccaccaatacttgtgagtgttttttctcgcctgtcataaactccacgttagttcgcaggacacggaaggcctcgttgatcaggtcacgcttaccttccttgacaagtatagaattcttttctttcacttttttcgccaaaattcctcgacgggacttctgttcacacaaaggaatctctccggcaaaaggcagggagagattttccagatcttttcgcccccgaatcttcgtgttcatgttctcccgcatgaagataatcacggctgggatcaataatcctagagcaagagccaccagcaagatattgcggcgtaccggtgccgtgggtaccatactgcccgtgggtggggtaatgacacgggtgttgtaggcggtaaacgcttgagacaattcattttcctctcgtttttgcaataaaaagagataaagcgcctccttcactttctgctgacgttccacggaaagaagatacttggcttgtgtcgggttggccgcaatgcgcccagctgtctgctgttcgctgcgttgcaagtcccgaatcctggtatttagcgtcacttccaaattattgatggatgaaatgatagcttcccggatagttgccaatgactggtcaatatccataaccaaaggattttgctcgctactgttcgccaccagattgttccgttgtaattgaagcgtattgtattcggatatctgtttttcaattccgacattttccaaaccggaattggcagggagcaactggttttgcccggccgtagtggccagatagttacggatatatcttaccaaggaaagttgggtgttcaacgcaaggatttgagagctaatctggctgctttgtgtcatatacaggttagaagccgcttgtacgtcaggcagaagatgctcgcttttgtaagaggatatattttcgtccacattacccagttcaccttctattaccgccaaccggtcactgatgaaaagactggtactgacagcgacctgatttttatccttcacccagttttcattataaacggcgatcaccgtatttagaatatcttccgcgcgggccggggacacgtccctatagcttaaactcaataccgttgactcctcgtcgttcaaagcaacggaaaggcgggaagagcaggtcctgaccgctccatacaacccggaacggactacacgcactttatactccgttccacgaacataaccggacgtcgtctctaaggtaaccttgccaagcggggtattcaacgtgccgggaaattttcctgtaacaggcttgacctccttaagcgactcacctctcaatacaaaatcagaaagttgcacacgtccgtctttatagacatttaccgtgaatccggcagactcattctcctgaagcccggtaatgttcgcctgaaaaggcagtgccattccataaagcaaccggtcatgaaaacgtcccggagcataatagctcatgtccagatggagacgtttcaccacttccgtcatgacggcaggagactgcaaagcgatcagctcattattgacgttcgtcgtcgaacggaacagaccgaaattatcaaagccttcaatatcggacgagatggatcgtccccgatattcccgtttgaccagaagtgccgctgtacgggtataaaccggaggtgtttttagcaaataataatagccgattccaaatgctacgagcaaggaaaggacgaaccatttccatttggcggcacagagatagagcaggtcctgtatgcgtaggcaatcatcagcctgtcccggttttgtattgttttgtattgtcatggtctattttgttaaacgaaattattaaattattttacaataagaaccgcaatgctggtcaacaatgaagcgagagagatccagaaagaggtacttcgcacattattcccattcacagtggactgacgggcttttgtactgttcggctccacatacaccacatcgttctgttgcaggtgataggctggagatgtataaatatgttccccggaagtcagattaactccatatacccgttgtgtattgccctcctgacgtaacacgagcactttttcccggttcccgtaaatggtcaggtctccggccatgctcagcgcatcgagaatcgttaaccggtcgcgatcgatgttgaaccgtccgggagcgtttacttcccccatgacggaaaaacaaagattcataaactctacagttacaaccgggtctttcactaaattcttggataccaactcatcctttatgtaggaggcgatttcaacacgtttcattcctgccacatgaatttttccaagtacgggaaaatcaatgtttccttgatcgtccacagtatatccagaaacaccttgactagtaccgacagagcctcgtaaagaagattgtcccaattgtctggatacgtaaggaagattgaaaaggtctgtcagttgcggatcacgactgttcacgatgatggaaatcttgtcttccggacggaccctgatttccaaggagtccgcgaccgtcacctcgctttctccaggatgaagatcttggaaataaacgatatttttggatgttgagcaggaactcaataaacaagcccctgaaaggaacaagaacatgaactttatcaatattttcatgcggaatatatttatttatagatttgataatttctttctagtatgcaaacggatagcgtaattgatgcataattgcattgacgtccataaaacgatatctataatgagtaaccaaaccgtcccgacctttcctgtcagtatccagttaagtccgataaaagacaaggatacacataagatggtcaccatgacggcacgaacgcgcattccggtacgaagcagtttatgatgaaaatggttctggtccggcaagaacgggttcttcttttcacgcaaacggtgtacgaccacacggaccacatcgaacagaggcactatcaaagtggaaaaagccagaatcatgtccgtattcactctctccccgtttttcgtatctgccatactcaggtgaatgaccagcaaactgataatataacctaaagtcaggcttcccgcgtcccccatgaagagcttatgcccccgttgtgcattgccgaaaacattataaaaccagaatggtaccaacactccaaatgtcgtaaatgcgagcaaagagtaaatgtattcttctcgtatggcacaaaccatacccaatacagctaacgtaatgcaacataatccggaggccagaccatcgataccgtctatcaaatttatcgcgttggtaatgtataccacaacaaacagggtaaggggaatccccacaaaaatcgggatctcataaatcccgaacaatcctccgagagaattgatccattctcccggatagacaagcaacaaaccgcttagaatttgcaccaaaaatttatggcgatagcttaagctgattaaatcatccgttataccaaccaaataaagcatcatgctccccacggcaaaaaaaaggaactcgcaaagggcttgatttgcatctagattttcaagcgggaagcctaaatgatagcgtattcccatgatcaaacagagggaaatcaatatgactgggaaaaaagacaagccccccagacgcgggacaggcagagtgtgtaccttccgcttgtccggctcatcaaacaaacgcttcttataggatatcaacaggattttggggatgacaatcattccgagagtaacggcgaccatgcacccccccaatatgaaacagagaaaatagttcatacgtaaaagtgtttagtatttcaaatcatgtttatggcatttttactagaaaacatttcggtatgtaggaagtagccacagcgcagacaccttcaatggcaacaaccaggcggctgtttttccgtatacggcaaatatacccttccgcacctttgaatttcccgtcaatcacctttacatgttccccacaatggaatttaggttcatccgcaccgaaatattccataccttgctctccggacgaggaaaccaacataaaaatattcatttcacgttcaggaatggcaaggggcctctttctcccgtccttgtttcttgtatacaaaatcactttgtctttgaatcgctcctgtacattcacagcctctaatattgtagattgaaagaacatcagtgaattgataacaggtttacggacaattttttttattccattccggacaatcaatacctcttcacaaggtatataagattttatttgttcttttctcaaggattcctctatctcaaaaactttgttataaaatacttttagagcgaaccaatgtttggtgttacatgttagggagttcaatgagtgctatgtttattttagttttaacaaaaagggcataccttccattcctgcacttttactttggattttaaaataaaagaagtgcagcaatcaaggttaatccgcatattttcaatatgaaaattcggatcccggaccattcctgactacagtgaatggaagaccgtaaccctgtattttttacgtttctacgtaagagatggagatgctattcttttgcttgataaacagactaataaaccgaacaaaaaaatattttttgctcggtttaatcggtttgtaactcgaatatatacccaagcaaacaataagaataagatcctttcattttacaaatgagtcaggatgttatttagaattatactaaattatcttataacatactgataatcaataatatatactgatggggggtaaaattaagatttaaattgttcttattatttttccattttacttataatgcttatatttgcattgtatttctatgtttcttacgtagaaaccataaaattcaacttcttcaaaattcgattattagcattgtctattatcgtgttatccaaagaatccagatagataagggttgtcctctcagaggcgtgccccattcctgcactaatgaccgaaagtggtacgttatggttacgtgctgcggtagcccagctgtggcgcgcaagatatgaggaaagaggtaacttttcaccaatctgttttcccagcagtttcagcttttgattatggtaattcagcccgttctgatattgccgataagccttttctggatcttcagaagtaatgataggaaaaacataagggctttcccatgtatctgacatatagcgttccaatatcatttccatgcagggttctatacgcaatgccaagagttgtccggttttgtgacggcaataagtaatcatccctcccgttacatcagtctttttcaagtaagccatatcaacaaatgccatgccacgggcagaataactgaaaataaacatgtcccgtgaaagagccagtgcagatgagccggacagatcgagctgttgcagtttcaagatggtatcctcttttatggcacgtttcgctgtctttgcgataccagtgtatacttcactgaaaggaaaagtctgtacaacaagtttttccttcacagccttattataagtagctcgtaaaattctcatatagaatgagctgctgttctttttcacctttctttttcccagccatttctcatacaggcaaagcaattcggaatccagcatggaaagggggatgtcaatatcatccaaaaaagaggagaagctgttcagagcacgctgataattatgcgcagtaccgaattgacctgcatctaaaagaatggaaacttctcttttcaaataacccaacatgcctgtttctaattttccagaatgaaattttccgatcacttcagacagggtatattcccttccactaccatccagttcacgtatgatttccctcaccatttccaaatctctttctatctgtctcttgtaggttgaaaccgtattttcattaccggtaacgacaatcggttcacgttctttctcattccaccaatgaggaaatatccgcatgtcggtggttatctgcctgttctcctgtctatggcagagctggtagcaaatggtgcctgcttttccttttacttttgagggacgaaattttacttttattgttgccatacttttttcgtttaaaaattaataaccagtctcataatacaaactatgacctattaatgttgcgggtaaagtggataaatagccttgttcttacaattacatctaaatccaccaaaatgaggaaattgggcattttctcatatgatgtgattaagaaaaacttcatacccctgcaaatcatcatattcaatatattatggactgtccgactctggaggtaaaggctgggacggtttggcggcgtaaacgccgttaaaccgtcctgttttcgttaaacgaaaacacaacttgctgtccgcaggagcggaccacgtttctacaataattattgtgtatcagctcattatatggctgtttctttgtgatttgcgggacatttccatcggatatttgccggcttctctccccataaaaggatggatatctctccatagtcatgtgacttacgcccataattcgggaataaggaggcgcatatacgggaaatctgccctttccataccctattctccattaatggattgctacttctacacttctgcaaatggagaacgggcatatagctgtgtataacttatgttttttcttcattgtctccattgatggattgccacttctacacttctacaaatggagaacggacatatagccgtgtacgacttatggttttccttcattgtctccattgatggattgccacttctacacttctgcaaatggagaacgggcatatagctgtgtatgacttatggtttcttatcattgtctccattgatggattgctacttctacacttctgcaaatggagaatgggcatgtaaccgtgtacgccttattggtttcttatcattgtctccattaacggattgctacttctacacttctgcaaatggagaacgggcatatggccgtgtacgccttatggcttcttttcatcgtctccattaacggattactacttatacacttctacagaccgataatttaagaatccgtatcaggacggatgtgtgcttctacacctgcccataaggattaaaaaggaccggtggacaaggaaacggaatctcgcccgcttctccacgccgctacggcagcggacctctgacgtcaccttcgcataggaataaccgtccgaacgcagcgtcatgtgtatcatgacaataaccgactttggatgactataaatgacaggtggttccgtcctgtactcttcttcctttattttgtattccgatacaataccagttgtgtaatttaataatttaagattttaagatatggattcagaaaaggaaaagaaccggctttccgatatcgttctcgagagggtcggactcacggggaaccttctgtcagatcctgtttctccagccccggaaccggcgatgagggtgccggggcatgaaaggccggtgggggcaggtaaagtgacagacccggaagaatacaagaggaagtttctggttcccgctcccaagacctcggagtggaagaccgcatacattgacgggagactgcaccgccggatcgccatgctggtcagggccgctggttgcggcagcatctccggttttattatccggctgctggagctccatatggaggaacacagggaggacatcgccgccctgctcggtgaggtctaccgtccctgggatgagaacgggcagccgaaaggaacggcccgccgataaaatgttgtcattgttcaagaaggcatatcatgacaggaaagaacgtaaaaggccggaccggtcccggcgggatggacgcggagcgcatccgtgagatcatgggggaagcgccagcctgtccccggaagggacatggaacgtccggtaacgacattatgtgacccgcaaggaaaaacggccccatgcagccgtccgtctacggaaaggagtacctgcatggcattgcgggcgtgcagcgccggtcgctgcatattcccgccgccctgcaccggaaactgtccattctggcgggagcctcgagaaacgggaaggtcacgctggagggattcatcaactaccttgtctcgctccatctggaagaatacagggaaacggtggacatgattctggaggagtccctgcccggccggccataaaggcccgttccccatgacaggggatctcccccggtgggagcatcgtttttttgtttctgaaacaatagtgtttaacatttaatggaaaaagaagtatgatgaaaaaagaaaaagagttgttggttgccatcgccagccagaagggtggcgtggggaaatcggtctttacggtactgctggccagtgtcctgcattaccgcaaaggtatgcgtgtggcggttgtggactgtgactccccgcagcacagcatcgccctgatgcgtgagagggacatggagagtgtcatgaaaaatgacgacctgaaggtaaacctgtaccggcagtacgagagaatccggaagcctgcctatccggtcatcaaaagcgacccggaaaaggcaatggaagacctgcggcgttatatggacgaaaaaggggagactttcgatatcgtgctcttcgaccttcccggaacgctccgcagcgagggggtggtccataccgtctccgcgatggactatatctttgtcccgctcaaggcggacaacatcgtcatgcagagttccctgcagtttgccaaggtgctggaggaggagctgatcgccaaggggaactgcaacctgaaagggatccggctgttctggaacatggtggacaggcggggacggaaggacttgtatgatgcctggaaccgggtcatccacaggatggggttgcggctgctgtcctcacacatcccgaacaccctccgctacaacagggaggcggaccctgtctgcaagggtgtcttccgctccacgctgttcccgcccgatccccgtcaggagaaaggctccggccttcctgaactggtggaggagatatgccccgccatcggtctggaggaatcgaacaccgaccggtagcggacgataggatacagataccttaaataaggacttttagcctaagataaagtaagctaatagcatgataataaggctcttataattacgacttctcctataaatgcattaccttagcagtataataataaaggagttaacaagttatgaacgagcaaattagaagcattttagcacaagagacgacaaagacaagcaagatccggcagctgttccttctgggggttccccgtgcggaaatcgcgaggatggtgaccaacggcaattacggtttcgtggtgaacgccctgcgccggatgagggaacgcgaaggcggtctgaacatccatccggcgacaaccgcgttggattacactttcaaccgcaagttcggtatcgagatcgaggcttacaactgtacccgtgaacggctcgcacgcgagctcagggaagccgggatagaggttgcggtggaaggttataaccataccacccgtccgcattggaagctcgtgacggacagcagcctgaacggtaacgacacattcgagctggtcagtccgatcctggtcggtgaagccggcctgcgggaactggagaaggtctgctgggtgcttgagctgtgtgacgtgaaagtgaacgggagctgcgggcttcacgtgcatatcgatgccgccggtttcagcatggagacctggcgcaacctggccctgagttacaaacatctggaaccggtcatcgacaggttcatgccggcatcccgcagggacaaccgctattgccggggactgggtcatgtctctgacgagatgatacgttcggcccggacggtggacgagctgaaaggaaggatcggcgaccgctaccacaaggtgaacctcgaggcctattcacggcacaagacggtcgagttccgccagcattcgggaacgaccaacttcacaaaaatgcgcaattgggtgctgtttctccacaaattggttacctttgccacgagggggcaagtgcctgcggccaccgcgctccaggacatccctttcctggacagtgaacagaaactctattataaactaaggactaaaaaattatcagcatgagcaagcatatgtatattttggcggatggcggcaggattgccgcctccgacccttccgagtttgtacgcctcctacgtgagggcagctggttcgacagcgaatgcaccgacgaggagtatatggtgaatttctccgggcggtacagggaactgcacggggtgacggtaaggaccgacacgccggagcatttcatggacgacctgaaaaagtacggttacatcaagggctgagaagcccgctcctttattattgcgatccccgccagcacaccttcggtgtgtaccggcggggatttttcttttctcactgtaccggatatccaccatatcctgcttttcaaggggggctggcttcacgcctcccttcgggaaagctttttttcttttcaccgccccttccgccatgacagaaactgactatccatgacaatacatgacagggtatttgaggtcattccgcttgttatttcctttgtggcatgaaacggcaggaaagcttgccggcaataactataaaaaagaaatgcacatgaaaaaagaacctttgtttatcgcatttgccagccagaagggaggagtcggcaagaccgccttcaccgtgctcacggccggtatcctgcgttaccagcggggatacaacgttgctgtggtggattgtgacccgccccagcacagtatcggtctgatgcgggaccgtgacctggaacgcgtcaaggaaaacgattccctgaaaatggccctttaccgccagtacaagcagaaaccgcaaaaggcctatccgatcatcaaaagcgagccggagaacgcggtggagaacttttaccgttatatgagagaacaggagacagagttcgatatcgtgctgttcgatctgccccgcgcattccgctacaaggggataatccgtaccctggccttgatgcactacattttcattccgctaaaagcggacgatgccgtgatgcagagcacactgcagtttgcctctgtaatccaggaggaactggtttcccatgaggactatcccctgaaaggaatccatcttttttggaacatgatcgacaagcgggaggacaaagggaccttcgaggcgtggaacaaaaccatatgtgactcaaaactgcacctgatgacaacctgcgtcccggagaccaaacgttacaatcgggaagcaagcagcatgcgaggcggcattttccgttccaccttgttgttacccgacaatcggcaggtaaaaggttcgggactcatggagctggtggatgagatatgcggtatcatcggtcttgcggaaaaacaaggggaatcccccatgacaaaccttatgtagaccggtatggagtacgcattcattcttctgttcctgtatgcctcctacctgagcgtagagaagtacgtccacacgggcagcgtccttaaatggaggggaagacggcgtccagtctccgctcccccggtgaaggaagaacctgtagagccacaggaggaaacgtctgaggaagctgtcatcggcaggagccggtaccggttatggcaattcccgcctatggacgaggaatacgtaacgagcgaaaagtggacggagacggccatgaaggagagaaagacacccgtgcccgaattccccgatcctttcgggaggccggaggacggggaagtgccggaacgctacgagatcaccggttatgtggaacgtcccgatccccaccgtgccagaggcgtgaccttcgacgacatggacctgctctccaggttcatgaccacggaccgcctttcggaacaggaacagtcccatgcccgccagacgctggaacggctggaggggaccgacatggaacgcatcctgcaggccggcatcctgggcagcgacgagaggctgaaacgttacatgagactctatgtggacagcgacaaggagccgcccctgctggcgggaaaggacagggaacgcattatcaaggatttcgacatcatggatttcataccccgataaccaacaatatagtgtatatggcgaagtatcataattcaagctgatccaccgggcattttcccaaaaaaacaaaagccgccgggcggcaaggtcgaatttaaaagaaggaggtaacgatgaccgggtactacgattcgggatgatctggcggacatcccgttccgaagagatagcaacacgagtagcaaacatttaaaaaaggaggtaacgatgtacagttattatgactccggctgatgccggcagtaaacatgtggttgcaaggacggtccacgggcatccggggccgtagaccgcaaaaaaaggaaatccgacataacaataaatacaggtatgaaagtgtatcatgactcgggatgatctggccagacatcccgtcccgaagagacagcaacacgagtagcaaacaattaaagaaggaggtaacgatgtacggttatcatgattccggctgatgccggcagtaaacatgtggttgcaaggacagccgcgggccatccggcctgcggcctgtttagaaagaaagtctaacgaacatttataatattaggtataaaaataatgagacatacgaaatcttcttcatttttacgattctcccctatgggcaaagtgacggacgcattggcatcccttatcgggcgcataccggtaaagacggccttcctgctggcatgactggccacatgaacggcccccgcattcgccgtcggtgacgggtctgccgggctggtgcaggccacgcagatggtcaccggatattttgacccggccacgaaactgatttacgcggccggtgcgctctgcgggctgatcggggccatccgcgtgtattccaagttctcctcgggcgatccggacacgggcaagaccgccggcagctggttcggggcctgcgtgttcctgatcgtagcggccacggtactgaggtcgttcttcctgtaaccttcgcgccgtatggaatacaagctgaacaagggcgtcgggcaggacgtggagctcttcggcctcaaggcgcagtacctctatctcttcgccggcggcctgctcgccgtcttcctcgtgttcgtcatcctctacatggcgggcgtgaaccgctggtcctgcatcgccctctgcgtcgcatcggcctcggggatcatcctcggcgtgttccgcctgaacaggaaatacggcccccacgggctgatgaagctggcggcggcaggataccgaccctattacatcatcaacagaaaacgtatcacctcactttttaaacgaagaaaatatgcgaaacatactcaaagcggccaccctggaaagtaagttcccccttctcgccgtcgaggacgggtgcatcctctccaaggacgcggacgtgaccgtcgggttcaagatccgcctgccggaagtcttcaccctcacctccgccgattacgaggccatgcacggcgcatgagggaaggcgatcagggtattgccctgccataccatcgtccaccgccaggactggttcctggaggagaggtacagggcgcgtgccggcaaggaggagccgggattcctggaccgcagcttcgagctccatttcaacgagcggcctttcctgaaccatttcccgtacctgttcatcacccgtaccacgaaggagcgcatgcggcagcagagcaacttctccgtcctctgcagggggcatatcctccccagggaggtccgggataaggacggtgtcctccgcttcctggaagccgtggagcagttcgagcgcatcatcgctgattccgggctggtccgtctggaacggctcacgacggaggagatcaccggaaagggaaaggaggccggcctggtggagaaatacttctccctctcgcaggaggacaccaccacgctggaggacatccggctcgggggttcggaaatacgtgtcggcgacaagcggctctcggtgcatacgctctccgacgcggacgacctgcccgctgcggtacggaccgacggacgctacgagaaattctccacggaccgcagcgactgccgcctctcctttgccgctcctgtcggattgctgcttccttacaatcacatctataaccaatacgtgttcatagatgatccggcagaaaccctccggcatttcgagaaaacggtcaggaacatgcgctccctctcacgttacagccgcgccaacgagatcaaccggcagtgggcggaggagtacctgaacgaggcgcattccttcgggctggtccccgtgcgctgccactgcaacgtcatggcctggtcggaagacagggagaggctgaggaatatccggaacgacaccggctcggccctggcgcagatgggttgcaagccccgccacaacacggtggacgcgcctaccctttactgggcggccatccccggcggggagggcgacttccccgtcgaggagtccttccacacgttcatcgaacaggccgcgtgcctcttcatcggggagacgaactacgcctcctccctctctccctttggcatcaagatggcggaccgtctcagcggcaggcccatccacctggatatctcggacgaaccgatgaggcggggaatcacgaccaaccgcaacaagtttatcctggggccttcgggcagcggcaagtccttcttcaccaaccatctcgtgcgcaactattacgaacagggcgcgcacatcctgctggtggacacgggaaacagctacaaggggctgtgccggctcatccatgagcgcacccgcggggaggacgggatctacatcacgtatgaggaggaccgcccgatcacgttcaatccgttctacagcgaggaccggcagttcgacgtggaaaagagggagagcatcaagacgctgatcctgacgctctggaagcgggaggacgaggtgccgaaacgctccgaggaggtcgccctctccggcgcggtgaacgcctatatccgcagaatcacggaaaccccggagtccaaaccggatttcaacgggttctacgagttcgtccgggatgactaccggcggatgatggaggaaaagagggtacgcgagaaggacttcgacatcgacgggttcctgaacgtgctggagccgttctacaagggaggggactatgacttcctcctgaactcggacaaggggatagacctgacccgcaagcggttcatcgtcttcgagctggacaacatatcatcgaacaaggtgctgctcccggtggtgacgctcatcatcatggagacgttcatctccaagatgcgccgcctgaagggtatccggaagatgatactgatagaagaatgttggaaggccctgatgtcggccaacatgagtgcctatgtcctgtatctgttcaagacggtcaggaagtatttcggggaggccgtggtggtcacgcaggaggtggacgacatcatctcgtccccgatcgtgaaggaggccatcatcaacaactcggactgcaagatcctgctggaccagaggaagtacctcaacaagttcgagcggatacagacccttctgggactgaccgacaaggaatgctcgcagatcctttccatcaaccgcgccaacgacccctcacgccggtataaggaggtatgaataggactgggaggtgtgcagtctgccgtctatgccacggaaacctccacggaagagtaccttacctacacgacggaggagagcgagaagctggaagtggaacggatggcggcaaggaccggcagcatggagcaggccatacggatactggccgcggaaaaaagcggcggcaggaaataagttttacagaacgattaaaagaacgattcaatgaaaagaaaattactatgggcggcatgcgcctttttactgaccgtaccgccggcgcatgcgcaatgggtggtgaccgacccgggcaacctggcacagggcatcgtgaacagcgtcaacgagatggtggaaacctccgagacggcgcagaacgcgctttccaccttcaaggaggcctcgaaaatctacgagcagagccggaaatactacgacatgctcaagagcgtgaactcgctggtcagcgggagcctgaaggtcaaggagtccgtgctgatgctctcggaaatctcggagagctacgtgacgaactacgggaagatgctcaccgacgagaactatacgcagcgggaactggaggccatcgccttcggctacaacaacatcatgaagagaagcagcgcgtccgtggccgagctgaagaacatcatcacccccaccggcatgtccatgaccgacaaggaacggctggacctcattgaacgggtgtaccgcgagatgaggcactacaagacgctggtgaactactacacccgcaagaacctgcgcgtctcctacctgcgggccagggagaagggcgagaccggacaggtcctggaactttacggggagaacgaacgctattggtaaacccttaaaaagacaagaccatggtattgttatccctatccttcgacagcctgcacggtatcctacgcaagctgtatgacgagatgaccgaactgtgccagccgatgatgacgctggccacggccatcgccgccctgggcgcgctcttttacatcgcctaccgcgtgtggcagtccctctcgcgtgccgaaccggtggacgtgttcggcatgctgcgccccttctgcctgggcatctgcatcctgttcttcgacgtgatcgtgctgggaagcctgaacggcatcctgagtcccgtcgtgcagggaacgggggcgatgctccatgaccagaccttcgacgtgaggaagttccaggaagaaaaggacaggctgctctccgagatgcccctgaaggtggccgtgaccggggagttcaaccccacggacgaggagctggaaaaggagatcgccgacatgggctggagcggggaggactacgcggtgatgcagcggatgtcctacacctgctactccttctccctgcaaggcatcgtgcagaccatcctgcgcaaggtgatggagttccttttccgtgccgcctcgctggtggtggacacgatccgcaccttctttctcatcgtcctctccgtgctgggacccctcgctttcgcggtatcggtcttcgacggtttccagggcacgctcgtgcagtggctggcacggtatatcagcgtatatctctggctgcccatctccgacctgctgggggcgatgctcgccaagatacagacgctggtgctgcaaagcgagatggagatgatccgggaccccctgagcgccctctccccggacgggtcgacagccgtctacctggtgttcatgctcatagggctggtcgggtacttctgtgtccccaccgtggcgaactgggtggtacaggccggaggcatgggcgcgtataaccggaacatgaacaacacggcgggcaaggccgccaacgtgggcggggccatagccggggcatccacgggcaacgtggccggagtgctgctgaaaaagtaaagacaaccggataataacattcattcaccgtaagacatggaattcaagagtctgaaaaacatcgagtcctcgttcaggcagatacgcctgttcagcctcgtcttcctcgccgcatgcgctctcctgaccggcttttccgtctggaagtcctaccggttcgccgaggcgcagcgggagaagatctacgtgctggacgagggcaagtcgctcatcatggccctctcgcaggacgccgcgcgcaaccgcccggtggaagcgagggagcacgtgcgccgcctgcacgagctgttcttcaccctggcccccgacaaggcggccatcgagtcgaacataaaccgggcgatgtacctggccgacaagagcctgtacgggtattaccgcgactggaacgagaaaggtttctataaccggctcatcagcgggaacgtcaaccagacggtggtggtggacagcatgcggtgcgatttcgacagctatccctaccgcgtcaccacctatgcccggcagatgatcatccggggaagcaacatcaccgaacgctccctggtgacacgctgccgcctgcagagcacggtccggtcggacaacaacccgcagggcttcctggcggaacacttcgagattttggaaaacagggacctgcgtaccgtggaaaggtaacggtgtcccgcagtaatcaatcattcaacaatatctggaaaatggatataagatcaacggcaagggaaaggctggaggcatatctggacggcctttccgagaaacagagacggggcatcctcgtggcgatgctggtccttacctgcaccgcatcgggcatcgtcctggtgcgtaccgccggccggctggcaccggcaggagggcgcatggagctccctttcggggaaggttgcctcacggataccctgcgcaggctgcccgatcccctgaagggacaggaaacagacatttaccggaccattaaacaaccccagcaagatggaaaacaggaaaagtaacatggaagaagaacacgtgccggccggggaagccccggaaggcacacggccggcggaagccggggtcattccctccgaagggacaaaaccgggaaaacggctcagcgaggaggaaatcctgcgccgcaggaaatacatcgtcataccggctttcgtgctggtgttccttgcggtcctctgtctgatattcgccccttccggtgacagcggggaaacggcggcgggcggttccggattcaacgtgaacgtgccggaacccacgacggtccaactggaagggaataaaacggacgtttatgaaagacagcaggcccgtcgggagaaagacagacggatgcagtcgctttccgaccttgccggaaggctgctggaagggaaaaagggcgcggacagcattccttccccagatgggagcatacggcagtcggcggacacttacgggcagatcgccgggcagttggagagcttttacgaaactccgcaagcgacaaccggcactctggaacaaaaggtggaagaactgtcccgccggctggaagaggcggaagcggaaaatcgccggacgggatcccgcgaggagatgatggaacagtcctaccggatggccgccaggtacctgaacccgaaaccggaagccacacctgacaaggtggaggaggaaaagccggagcctgtccccgtcagccgggtggagaccggaacgacctccgccctggagcagccgctgacggattccgcgtttgtcgcctcactggccgtggagaggaactacggcttcaacacggcggtgggcagcagctaccggatggggatgaacaccatcccggcctgcatctccgagagccagacccttgagcagggagggcgggtgaagctgcgcctgctcgctcccctgcaggccggaagcgtcaccgtgccggccaacagcctggtgaccggaacggccgatatccgtggggaacgcctggacatcctggtaagcagcatcgagtatgcgggcaatatcattcccgtacaactgacgacatacgatatcgacgggcagcggggcatcttcgtgccgggttcggaaagccggacggccgccaaggaagtattgggggacgtgagccagggcatgggaggcagcatctccttcgccggttccgccgggcaacaggtggcgatggacctcacgcggggtgtcctgcagggcgggacacggttcatctcgcaacgcgtcaaggcggtcaaggtaaagctgaaagccgggtacaaggtgttgctggtcacaaaaaagcaataatgacgtttaactgtaatcttttttaaaaacaatcattcaagatgagaacattcattctttcaatcatggccgcgctggcgggaatggcctgccgggcgcaggagcccaggccggagggcggggtcaggatcctgaccgccggccagcatatcacgccctacaggatcggcgtgccgttcagcaagacggtgcatatccttttcccctcggaggtccgctatgtcgacctgggcagcacggacatcatcgcgggcaaggcggacggcgtggagaacgtggtgcgcgtcaaggccgccgtccgggatttccccggcgagacgaacttctcggtcatcacgggggacggctcgttctattcgttcctcgtttcctacgatgaggagacggaagcgttgaacatcaacatggacagccggtttccggcagggccctccgcgggcgggagcgccgtccgtgtgaccgagctcggcgaggaggacccctcggtcatcgccagcctgatgtacaccgtacaccgtctggaccgcagggacgtgaagcatatcggctgccgccagttcgggatgcaggctctgctcaagggcatctatgtgcataaggacctgctgttcctccacgtctcgctggccaattcctcccatgtgcccttcgacatcgacttcgtgcgtttcaaggtggtggacaagaaagtggccaagcggacggcacagcaggagacctacatcgagccggtgcgcgcgctcaacgagctcaggcgtatagagggcaaaggggaaggacgcatcgtctacgctttccacaaggtggtcatccccgatgacaagctcatcgaggtggagatttacgagaagggcggcggacgccaccagcggttccatatcgagaacagcgacctggtggacgccagactggtggacggactgataaaggagtaatcccatgaaaaaatatctgttcataaccatgtgcgccttcctgtccctttggacgggcgaggtttccgcgcaacgctacctgcccgggcagacgggacttcagctgacgctgggcggcgtggacggcttcggaaggaacgtaagacacctgagggggaatttccaggccgggctggccctgagccgttacaaccgtaaccgctcgcgctgggtgttcggcgtggactacgtgaagaaacactatgcctataaggagacggccgtacccaaggagcagttcacggcggaggcgggctgtctcttcccgttcctctcggacaggggcaggaacgtgttcctgtccgccggcctgtccgcactggcaggctatgagagggtaaaccggaacggcaggctcctttatgacggggcgaccctgctgcacaagggggccttcatctacggcttcgccccggcattcgagatggaggcgtacctgaccgaccgctgggcttttcttttcaatgtccggcaacgcgtcttcttcggatcgtccgtagggcatttccatacggtagtggccgtaggactgaaatatatcatcgattaatcttttaagaacaggaaacaatgaaattaggaacattcatcatgggatgcgcgctggctctgccggcgtgcatgcttgccggctgcgacgaccgtctggaggtgcggcaggcatacgatttctcgctctcgtcctggtacctgcaggaaggcattgaaccggatgggacggtggagatccgtctgacgcttgaccgcgagggggattaccgcgaggcccgttaccgcatcggatacatacaactggagggtgacggcgaggtgttcgccgcggacggaaccaggctggtgaaccgcgagctgacggacctctccggcattgcggggctggacacgacggacatctgccgccaggtattcaccctcttttaccggaacacgggagaggacaatcccgagatccgcttcgtggcggtggacaacttcagagtggaacggacgctggacatcccgttctccatcgaggacagggcaaatacggatacaatcgactaacgaaaggcgggagctatgacggaacaggataaatacggcatggagcagcttgccgaatatctggacatgcgaatacggtacgaggaaaaaacaataaaggagatccggaataaactggaccgggattacctttatcattttgcgtggaccggggaggaattgttcaagtcccatttcatggtaaaacaatacggggaactccgccaggtaatccggcaggtgggagctcccggggaggtgcatggatatatacggcataaacgggaggaatgcctgaaggagctggtcagcgggagtatccgcaggcgcagtacggacgatatttccaacctggcacatacctaccggctggaatgcatgcagagactggtcaaggattatacgggcttcgaacggcttctctcgatgaaggctccccgcgaggaagtaaaagtaaaaacggagccggaaatgatgaaaaagaagtcgaacggattaaaaatataatggaatggaacaacaggaccccaatgtcataaggtttatggactggctggattcaacaatggaagtattggacgagaaaatccagacgggaacggtaaagtcaaatgcggactacctttctttctttgaggacaaggccgaggagctatacaggcagcattatatgtataaatgtttaaacgacctgcgttcccatgtcaggaaacttgaaacgccgcggcagattcaggagtacatacagcgaaggaggaatgcctgtctggataaactgctggaacaggacatctccgccaggagtacaagcccgatgagcaatctggcccacacgctccggctcgagtgctcgcagcagcttgtccgtgagtacgaccttcttgtccgtttccttaccgcaacgccgcgagagaggcaggaagaggagcgtgtctcaaaggtcaaccgggataaagcccggaagggaggattaagattatagcataaacaatgaaaaaggtaaagggaatgccaatttggagaggaaaggcaatgctgtgcatgcttgtgatgacactgttgagagccggtctgtcggcgcagccggtaaggatgcgacagggaccggacccggtaaagtttgaacttgcggtcagccttgtaaaacagtgagagggacttcatggaaaagacaaatttccgtactacggttatggacaccgccaattgccgggcgagaatctgtcctacgacatgacggaggctgaagcggaggcactgctccgtaaggacctcatgaaacgctacgcgttgttccgcaggtacggcaaggatgcggaacttctgatggttttaagctacaatgtcggaacgtcagcattgctcggatatgggaaacgccccaaaagccgcctgctccgaaagctggaggccggagaccgtgacatatacagggaatacatttcctattgccactaccggggacggaaggtcaaatcaatagaaagacgcaggaaaatggaatttttactgctttatgagaaatagataataaagaaagagggagagcctacgttatcttgtagtgctctcccttcattcatacagggttttcaacgtttcccacattacaaacaaccgtttttataatgcgggagtatgtcgttatgcctggtacccaaggttgaaattcagcagatgatggataaaaagcctgccgcgttccgtccatacggtatgcatggccgttccggtttctccgttccggttctgccatatatgcgtatgtgtccgggtatatccttccttctggtatcgggcggtaagcatccatgtccctgactggcggaactggaccccaagcaatttcagcctgtaattcagctccctcccgctcattccaagttctttggctatctgcgtggtcgtatatgtgcttgccgaatgcaggacctcgtcaaaataccttactttcggagcctgcaggctcaattcaatggcgttccgcgcgtttttctcttccagtacggatatatgcctgtcgcgttcctttattttgttttccgcgagcaacaaggcccgtgaaagcagttcggagtcggtttctccttttatgtcaagcaggtatccgccctcttttaatgttcgtgggacaaggtcgtcaaagatccagctttcgaacctctcggccgagggcaggcggctgccggccatcaggcggtaaaggttcccctcgtcgatgaacttcactttctgccggccgcctgccgtaaggaggtcgtggacgcgtacccccttcggtctgcaatgccggttgacggcatccttgggattggcgtatcccaacgccgaggccacgtccctggcgcaaaaccagaccctgcctccggcttccacggtccggaccttgccgaactcgggatgttctgttatgactaacgtgtgcatgtcgtttactgtttataggttgattctatcgctttgaatatctcatggattacctgagggacgatggcgttcccgtatcccttgacggactgctgccgccaggaagaaaagggaataccgtccaattgacggggaaccccatcatctcggccacaaacaggggattgagttggaaactcctcccagcctgggcaaagaaatcgggaaggctgccctgctgcgggttcttccccttcctcgcgaagtgctccaaggtcggcgcacccttccagtcccttgccgtcggggtcgggagcagcccgtggaagtccaggaagtctgtcaggccgttgggattcttctccccgtcctccgcctcgtgcatcgacacgcgcccctgacgtttccagcgttccacccgctgccggtggtgtatctccgtcgctgtcggggtgggcaggagcatctcgcggatgatttccggaagccctttctggaggctgttcgctcctctcggactgcaatccctcgccatcggcgtgggcaacaaaccatacccggtccctccggtgcggggcaccgacggcacaagccggaataagcagcggctggacggtatatccttcacgctcaagatcccggcagatggtctcgacgacgtattcctcccgcttgcggtatacaggctgatcctctccgaacagagagggctgacatcccacgtgagccgccttgccgggctgtaccacctggaggatgccaccaacgttctcaccaacgatccaaccgggccggatttcgtgaatggcacggagcatgtgaggccagaggtaacggctgtcctccgcgccccttcgctggccggcgactgagaagggctggcaggggaaacctcccgtgaggatgtcgacctttccccttcatccccgaaaatccgtagttgtaatatccgtataactttctgcatggctgaaccaataatttaaaatccggttacaaaactcgtctatctcgcaatggaaggcgttgcgccatcccattcattcggcggcgagatccgccgcgccaaacccgctgaaaagcgaggcatgtaccaactgtctcatattgaatcctattaatcggttaatgaatccgttacattcccggtctctttttttaccggaatggttattaccatctcgtcgatcttgcggtatatcctgcccatctccagcatgttcttcaaccgcaggatgtccgtgatctcgtagacggtcatgccgttctgcacgctgaaacggatgtatcccctttgccgttgcgtttccacttcctcgcgggtcatctgcagaagctcgcagatctcctccagcgtgaaggtcagctgcacttccttgacggtatgcgcgtaggtcaggatactcagcatctgcaggcatttgcggtgtgccttgacaagggcggcgaacttgttccgctcgatcatgatgtacttactttgattttccatttgtcttgctatttttaattgttatcggttcctgttcttcgaaggcttccggcagggcggccgtgccgtattcctcccggaggaacttgtacacgtcgaatgcccagaagtagaccttgccgctgatcttgaaggacggcagctttcccgacatgcgccagcgtatcagtgtccggtcgcagactttcagctggagacgcatgtcgcggctgtccagcatctgcttgccgttgaagctactgagtgcctccagctccatttccagacgggcgatgagcttgttctgacgctcgaagcatccttcgatcatccgcctgagctccatgatttcattcttgccttcttccattttccggttgtttttagttcgatactgtttttgtctttcttcgcctgcaaagttttggaaaatcagaaggcgaacatagggctgacggataccgccagccccatatttttttcagtaaaccattctgtatcaatgatgtctttccgatgtttttttgaagggataaaacttgattaccggaaatgattcattcgtgggaagagggaatatggtaaaaaggggatatcttacggatggaaataaaaagggaggttaagcccggtacaggacctgatctcccttgaaaatctttcatgaaaacttgctaaggtcaagtaaattaactacttttgtagctgaagagttatttgaggttatgcagaaaagcgcaagcgggcgatggatttccgtcaccaaatcgttacctgcctgttttctatgctccgcttatcttttgaaactcaaaaaattaaagagaactacgctattttaaagtaaaaaaggcaaactgaatgaacgtaaacaggctattaggaattttagctgtacttttattgaccgctgccagcgctctttacgcgcagaaacccgtaaaagtgaaaggtgtacaagggcgttggcaggtcagcgatgacatcacattgaagcaggcggaagagcgtgcttttatggaagcaaagaaagctgctttgcaaaaggcgggcgtgatggagaatgtgtggtctgtttttgggcagattacccaggaagacggacaggagcttcacgaagcttattcgcaaatgaatgtgcttgctatcggaggaatggtgaatattactaataaaaaggtagaagaggtttgggacacagatacacgcagcttgtataaggtagtaaccatcgatgccgaagtgcagaaagaggataaaccggacagttcgtatgctctcgaagtgaaaggggtggagacactctatcgtgagggggatgtgtttcactgtaaattgactgtacatggtacggattcatacttgaagtttttctggttcgacagtaatgggggagctttgctttatcctaatagttacgaacccaatacgttgttgaaagccggcaaagaatattcgattcctttcagtaatgctgtggactatcgtatggagaaacagcataacaaggagagcgagaagataaatatgatgatggtggcaactaaagaggatattccgtttactaaagaggtcacttatcagaatgtattagagtgggtgtactctattccggcagttcagcgttgtgctttttatgatatggtacttataaaatagtggttcccgaactactgaccgttaatcattaatcacttattatgatgaaaacgaaatattacttttctttcgtttttgcgtcactctttctggttccatccgttgctatggcacaggatgtgaattatcagaaggagtttgataatttccaaaagaaacagcagaaagaatataaagactttaaaaataaagcagacgaagagtttgccacatttctgaaggaagcgtggcaaaagtataatgcctctgtgggggattcaatgccgacacgaccggaaccggtgaaaccgacacttttcgataaaaagaaacctgtccctgctccggtagagattaagccggcggctcccaaaatacctgtgtccgatagaccgggagtaggggataaagtaaatgtggaagttaaaaagccggatctgcctgcggtagcagataagccggcacccggtgtctatgtaccgggtaaaccttatactcctgtgaaagttgatatcccggctccgctgcccggaagttcggcgcggcgcaatgtggttgagttctatggtactcagtttgaggtggctacggatattattgaagactttgtactgggggggacaagcgagagtaaagttgcggctgcttggagccggttgtgtaaagccgatcacgaacaattgattaacgattgcgtccgtttgaagaatgagcaccggatgaacgactgggcattcttgctgttcattaaacagttaggggtacaaatgtgtggtgctgcccggaaagatgatgttgcttttttacagatgtttattctcaataaatgtggatataaggtgcgtctgtctaaaataaacgataagctgaagttgttggtggctccggcaggaactatattcggtgttccgtatattactttcaagggcgtcaagtactatgtgtttgaagcagataagggcggttcgatggctgtttatacctacagtcaggattttgccaatgccaagaatctggtgtgtatggatttgaacgctgtgccacagttcggtatgcaagagttgggtaaaacagtgtctccttcggaaaaatctcttcttcaaatcaatgcggttgtcaataagaacctgatggacttttataaagattatccgcaatgtgaagttgctatctactataaaacacctatgagcaaagagttgaagagtgccctttacccgtctttgcagacagctataaagggaaaatcagagaaggatgctgcgaacattctgattgattttgtacaaaattcatttcaatatcagacagatggtgaacaatttggctatgaaaagcctttcttcatggatgagaacttttattatccggcttgtgactgtgaggaccgtgccatcttgttctccaatctggtgaaagacttgatgggattggacgctgtgctgctcgactatccgaaccatatcgcttcggctgtccggttcaacgaagaaatctcgggtgactacatcttgctggatggtaaaaaatatcttatttgtgatcctacttatatcggtgcaccgataggaatgtgtatggatcgtttcaagagtgtagctccggaaataatccgttagtgttaaatattataataattgcaggttcggggtaaaaaataccccgaattgcaatgttgatattgcaatattgtgtacttttgcggcgtgaaataacacaccctactgaatttatatacaatattaaatatctatgcttaatttaattaactctatcgttgcgcgtgcgcaagctaatcgccagcgcattgtccttcccgaaggtacagaggaacgtaccttgaaagctgccaatcagattttgacagatgaagttgcagatttgattcttttgggtaatccggaagaaattaatgctgccgctgccaaatggggactcggaaatatcaacagggccactattattgatcctgagaatcatccgaagaaagaagaatatgcgcaattgttgtgcgaactccgtaagaaaaaaggtatgactatcgaagaagcccgtaaattggtactcgatccgttgtatctgggctgtctgatcattaaaagcggtgacgctgacggacaattggcgggtgcccgtaatactacgggagatgtgcttcgtccggctctccagattataaagacatctccggggattacatgtgtgtcgggtgctatgctgctgttgacacatgcaccggaatgcggtcagaatggtctgctggtgatgggggatgttgctgtaactccggttccggacgcttcacaactggcacagattgccgtttgtacagcgcgtactgctcaggcggtagcaggaatagctgatccgaaagtagcaatgcttagtttctctactaaaggttcggcaaagcatgaaaatgtggacaaggtggtagaggcattgaaattagctaaagagatggcacccgatttgaatatcgatggtgaaatgcaggcggatgccgctctggttccttcggtaggtgcgagcaaggctcccggttctccggttgccggtgaggcaaatgtgctgattgtgccgagtctggaagttggtaatatttcttataaactggtgcagcgtttgggacatgccgatgctgtaggcccgattcttcagggtattgcccgcccggtaaacgatctttcacgcggatgttctattgaagacgtatacagaatgattgcaatcacagccaatcaggcgattgctgcaaagaatggtaaataattaaatcgaaaatcagatatgaaagttttagtgttgaactgtggtagttcatctatcaaatacaagctgttcgatatggacagcaaagaagtgattgcccaaggaggaatcgaaaaaatcggtttgaaagattcattcctgaaactgactttgcccaacggtgagaagaaaatccttgagaaggatattccggaacatactgtaggtgtagagttcatcctgaataccttggtaagcccggaatatggcgctatcaaatcacttgaagagatcaatgccgtaggtcatcgtatggtacacggaggtgaacgcttcagtaaatcagtattactgactaaagaagtgcttgaagctttcgctgcctgcaacgatctggctcccctccacaatcctgctaacctgaaaggagttgatgccattacggctattctgccgaatgttccgcaaatcggtgtattcgacactgcattccaccaaaccatgccggaatatgcatacctgtatgctattccttatgaattgtacaaaaagtacggtgtacgtcgttatggtttccacggaacttcccatcgttacgtttcacagcgcgtgtgcgaatatctggggattaaaccggaaggactgaaactgattacttgccatatcggaaatggtggttcgatcgccgctatcaaagatggcaaatgtatcgatacctctatgggattgacaccgttggaaggtttgatgatgggtacccgttctggtgatatcgatgccggagctgtaacattcattatggataaggaaggcttgacaactacaggcatttccaacctgttgaataagaaaagcggtgtggctggtatgatgaacggttcaagtgatatgcgtgacttggaggctgccgttgcaaaaggtgatcctcaggctatcttgacagaacagatgtatttctaccgcattaagaaatatattggtgcatatgctgctgctttaggaggcgtagacgttatcctgttcacaggtggtgtcggtgaaaatcaggcaacttgccgtgccggtgtttgtgaaggactggaatttctgggcgtgaaactcgacgctgaaaagaataaggttcgtggcgaagaggccattatctcagctgatgactcaagagtgaaggtagtggtgatccctacagacgaagaattgctgattgcgtctgatacaatggctatcctggataaataaaggttgataagtaatatagaggaaaggccggaggcggagatttattctctgtactccggctttttatatagtttgggtgtggagggaggcaatccgtttttgagcgctaagcagccggggacgagctatttaacagaatattcatatccctttctccttttcttcattttaaaagttttatctttgctatcactaactcaaataaacttaaatgatacaagaatgaaacgacttttttatttctttctttttgtctgtgtggcagttattgcgaatgctcaggcaaaatatgttttctatttcattggtgatggaatgggtgtgaaccaagtaaatggtacggagatgtaccgtgccgaaatccagaaagggcgcattggtgtggagcctttgcttttcacccggtttcccgtcggaacgatggctactactttttctgctaccaactctgtgacagattcttctgctgccgggacagccctttcaaccggtgaaaagacctataatggtgctattggcatggatgatcagaagaatcccttacagactgttgccgagaaagctaagaaagccggcaagaaggttggggttactaccagtgtaagcgtcgatcatgctactcctgctgctttctatgcacaccagccggatcgtaatatgtattatgaaatagctaccgatcttcctaaagccggttttgacttttatgccggtgccggtttcctgaaaccgactactacttacgacaaaaaagaagctccgagcgttttcccgatgtttgaagaagccggttacaccattgcccgtggatataacgattataaggctaaagctgccacagccggtaagatgattttgattcaggaggaaggtgccgatgcgggttctttgccttatgctatcgacagtaaagaaggtgacttaaccctcacacagataacggaaagcgcgattgattttctgaccaaaggaaaaaataaaggtttcttcctgatggtagaaggtggtaagatagactgggcatgccatggaaatgatgctgctacagtgttccacgaagtagccgatatggataatgcgatcaaagttgcttatgaattctacaaaaaacatccgaaagaaaccctgattgtagtaactgccgatcatgagacaggtggtatagcattgggaaccggaagatacgctctgaatcttaaagcacttgaaaaccagaaggcatctgctgaagaattgtctaagaagatcagtgatttgcgcaaagctaagaacaaccatgtggcttgggaagacgttaaaaatctgttgtccgaacagatgggcttctggtctgtacttcctatctcgtgggagcaggaaaagaaactgcgtgacgaatatgaaaagtcattcgtgaaaaataaagtagaatttgccgagagtatgtatgccaagactgaaccgatggcagccaaagccaaagaggtgatggatcagatcgctatggtaggctggaccagcggtgggcattctgcaggatatgtgccggtgtttgctatcggtgccggttctgatctgttcatcggtaaaatggataatacagagattccgagacgcattgcaaaagcgggcggatataagtaaccggcagataagttcaccatagagcacgcagagtatacagaggatttgttgatatacgtattaataaactctgtgtactctgtgtgttttgtaatgaacttgcctcgttgacgttaatttatcctcaatattctctatctttcaaagaatttctttagctttgtcttgtaaactctcaaagaaatatagaaatgactaagtttgaaatagaagaaaagatagtagatatgctcaaaaccgtattcgatcccgagataccggtaaacgtatacgatctgggactgatctacaagatagacgtcgccgaagagggagaggtttctatcgatatgaccctgactgctcctaattgtcctgcggcagatttcattatggaagatgtacggcagaaagtagagtcaattgagggagtgaattctgccactatcaatctggtttttgagccggagtgggacaaagatatgatgagtgaagaggctaaactggaactgggctttttataatcgttactgttttacctctattcttaaacgatccattcttacagtatgaagaacgtatatttcctttctgatgcccacttgggttcacgtgccatagagcacggacgtacacaggagcggcgcctggtcaattttctcgacagcattaaacataaagctgccgcagtatatctgctgggtgacatgttcgacttttggtatgagttccgtttggtggtgcccaaaggttatacccgttttttaggaaaactctctgaactgactgatatgggagtagaggtgcatttctttacgggcaaccatgatctttggtgtggcgattacctgaccagggagtgtggggtgacgattcaccgtgagccggtgactacggaaatctatgggaaagagttctatttggcgcatggtgacggactgggcgatccggacaaaaagtttaagttactgcgcacgatgttccatagtcgtacgttgcagactttattttccgccattcatccccgttggagtatggatttaggactgaattgggccaaacatagccgattgaaacgtgaaggggggaaagagcctgattatatgggtgaagacaaggagttcttggtgctttacacaaaggagtatctgaaaaatcatcccgatataaacttcttcatctacggtcaccgtcacattgaacttgacttgatgttaagtgctactgcacgtatacttattctgggcgactggatcaattatttctcctatgcggtgtttgatggtgagaacctgtttcttgagaattacatcgagggagaaacacagctttaattttccggagtcagttgccggagacgaatcagataagcccttcgtcagcaaaactataaaaacaaccgtcgcagacaatgatatgatccgtcagggtaatgttcattgtttgcgacgctttttgtatagctgccgtcaggcgtttgtcttcctggcttggttttgcattgcccgacggatgattgtgaatcagagctatctgcgtggcacgtcctatcagggcttcccgcaagatggtacgtacatcggcgtatgttccgtcaatcccccctgtactgatacgtaatttgctgattactttgcatgcctgattcaaaagtaggatccagaactcctcttgtggcaggtcgcacattaatgggtggaacagcctgtaaatgtcctctgagcatctgacttgtttacgctctttgctttcctgtagtttgcgccttttccccagttcaagagctgccatgatagtaagacttttggcgggtcccatgcccttgaacgaggaaaagtcccgtacttcccatttccccagttcattcaggttattgtcgcaagaggcaagtacccttctcatcagttcaacggcactctcttccgtattgcccgaacctatcaagatgcccaacagctcggcgtcgctcaatgcttcggcaccttttgccatcattttttcgcgtggcctatcggctttggaccactggttgatgtttagtttttgtttgtttttcataagtcggatagagagtgtttgtattctttttatatcaacaactgaaagaccgccttttttatttatagaagttcttgcggaaagcttcaaactcgttttttcccaatacacagcgttcccaccacgcacgccagaatcccgttccgtatccgataagttggatgaaagaggcagcgatggaatagatgccgatgcgtaaacttttgttttgcagcgcagaatccagacagaccagcaatgtataaagcagaatcgggacaagactgaacaggcagaagggagtacataatagcagaagtgtaactcctaatgtgaatgcagccggtagcaggtggacgactttcaacgattcgggatattttttatagaggttgatacgcgcaatgccggagttgtgtacctgcttgaagaacttcttaaaatctgtgcgccgtttgtggtatacccaggcaccgggaaagagacggcatcggtatcctcctttgaaaatgcgaatgctgaaatcgatgtcttcgccgaagcgcatattagagaagcctcccaatgcctgatagacttcacggcggacacccatattgaaacttcgcggatagaacttatccattttctttttacccccgcgtatgcctccggtagtgaagaaagaagtcatcgaataattgatcgctttctgtatatcagtgaaagaactatgtgcccggtccggtccgccaaaggcatcggccggggtggcagaaagttcctgttccactgcatcgaagtatccttcgggaaggatacagtccgaatctaatatgataaggtagtcccctccgctgcgttcggccccgtaattacgggtctgtcccgggccggagtttggtttggcgtaataatgtatgtccagtttcccttgatatttgtttactatcgcttcgcaagggacagatgatccgtcttctaccactatgacttcgaaatccttgaaatgttgggtagtgaggctttgcaataattcgtccacttcatcgggacgattgtaaacggggataataacggagtatcgcataggtttaatgataatcggttgttgacttgcaaatatatgccattatttttcgataaccgtcatggatggtaataaaaaaatgtggtccctattcccgtaagggatagaggccacattttttttcggcagttaacctgtttatgcttttacacgacctacataagagccgtcacgagtatcgatttcgattgtttcgccttcgttgataaatagcggaacacgaacggttgcacctgattctacagtagccggtttcaatgtgttagtagctgtatcccctttcatgcccggttctgtataagtaaccttcatctgaactttgataggcatatcagcgtaaagtacggtttcagtagaagcatcagatactacttccagaacggcaccttccaacaggaagtctacaccgttgatcaggtcgtgggcaatcgggtgttggtcgaaagtttcctgattcataaagatatagtcttcaccttctttatataagaactggtagggacgacgttctacacgtacatcttccaacttctcaccgatgttgaagcgacgttcgagaacgtatccgcttaccacatctttcagtttagtacgcatgaaagtgttaccttttccaggtttaacgtggaggaattcgatacagaaatacagtttgccatccatgcggatacaagttccgttcttgatgtcttgagcattaatcatacttgatattctttattttatagattgttattgagttatcttcgaaccttttcgggtgcaaaagtaatctaaatcggcaaaaaacacaaaatgttttgactaaaaatgacttaactcttggtttatttaaaaaaagtgcctatttttgcagcccgaatccgtagaaataataacataaaacaagatacagtaatgaaaagaacatttcaaccctctaacagaaagagaaaaaacaaacacggtttccgtgagagaatggctacagctaacggtcgtagagtattggctgcgcgtcgcgctaaaggtcgtaagaaactgactgtttctgacgaatacaacggagtgaaggcataagtattagccatagcaaacgaataagaagaagtgaaggaagattcctttgcttctttttgttttaataagcttttatcaaaaactcagtgaaactctgtgatactgtgtagcgaaaatagtatctttgtccggattaacagcttataattatgacgataaaagaatttttttctttcaaagccaatagattcttctgggtaaacatcatagccatggttgtggtggctgtgctcattgtgttcggcgcacttaaaggattggatatatacacacgccatggccaagctgtagtggtgcccgacgtaaaagggatgtctgtaagcgaggctgaaaagatgttccgggatcagggactgacttatgttgtgtccgattccaattatgtaaagaacaaaccgtccggcatcattcttgatcttaatccgtcggtcgggcagaaagtgaaagaaggacgaacgatctacctcacaataaatacactcagtactcctttgtgcgtagtgcccgatgtggccgataacagctccgtgcgtcaggcacaggcaaagttaatggctgctggttttaagctgaccgagaaccggatggtgagcggagagaaggactgggtatatggtgtcatttatcagggacaccagttgcagattggagataaagctcctattggtgctactttgactctgatggtgggtgacggggtgcaatctgccggagccgattcggtcgatatggtagaagatgctgccatttctgctgatgattctggtactgaagacgattcctggttttaatgtaagaaacgtatacgtagaaaaaacgcatgatagaagaattgcctgacgaacttgaacaggacgaattggatgatatagaacctgtaggtgatgagaaccagctctacgagcatttccgtgtggtagtggacaaagggcaggcgatggtccgggtagataaatatttgtttgaacgcatcgtcaatgcttcgcgcaatcgcatacagaaggctgctgaagacggttttgtcatggctaacggcaagcccgtgaagagtagctataaggtgaaaccgctggatgtgattacggtgatgatggatcgtccccgctacgataatgagattattcctgaagacattcccttgaatattgtctacgaagacaaatacctgatggtggtgaacaagcctgccgggctggttgtgcaccccggacacggaaactatcatggtacattggtcaatgccatcgcctggcatctgaaagataattcggactatgatgctaacgaccctcatgtgggattggtacatcgcatcgataaagatacttcggggttactggtcattgctaaaactccggatgccaaaaccaatttgggcattcagtttttcaacaagactaccaaacgcagataccgtgcactcgtatggggaattgtcgatcaggacgaaggtaccatcgtagggagtatcgcccgtaatccgaaagaccggatgcaaatggccgttatgcccgacccggctcaaggaaaacatgctgtcacccattaccgggtactcgagcgtctgggatatgtcactctggtggaatgtattcttgaaacagggcgtacgcaccagatacgcgtacacatgaagcatatcggtcacgtactctttaatgacgaacggtatggcggtcacgaaatcctgaagggaactcactttagtaaatacaaacaatttgtaaacaattgcttcgacacttgtccgcggcaggccttgcacgccatgacgctggggtttgtgcatcccgtcactggtgaagagatgcatttcacttcggagttgccggatgatatgacccggttgatagagaagtggcgaggctatattagcaacagagatttagaatgaaacgcaacattgccatcgtggcaggaggcgatacctccgaaatcgtagtttccctgcgtagtgcacagggcatttactccttcattgataaggagaagtataatttgtacatcgtagaaatggaaggccgtcgctgggaagtgcagttgccggacggaagtaaaacgccggtagacagaaacgactttagttttatgaatggggcggagaaggttgtattcgactttgcctatatcaccattcatgggacgccgggtgaagacggacgtttgcaggggtatttcgacatgatgcgcattccgtattcgtgttgtggtgtattggctgctgccatcacttacgataagtttgtctgcaaccagtatctcaaggcatttggcgtacgtatctccgaatcattgttgttgcgtcagggacagactgtttccgatgaggatgtgatagagaagatcggtctgccttgcttcatcaaacccaatttaggggggtccagttttggagtgacaaaggtaaaaacgcgcgaacaaattcagccggctatcgctaaagctttcggcgaagcggaagaggtaatgatagaagcttttatggccggaacagaattgacttgcggttgttataagacgaaagaaaaatcggtcgttttcccgttgactgaggtagtgacgcataatgagtttttcgattacgatgcgaagtacaacggacaagtagacgaaatcactccggcacgtgtatcggaagaactgaccgaacgggtacaggcattgacttcggctatctatgatatattgggatgttcgggcattatccgcgtagactatatcattacggaaggtgaaaagattaatcttctggaggtgaataccacaccgggtatgaccgctaccagcttcattccccaacaggtgcgtgctgccggaatggatataaaagatgtaatgactgatattattgagaataaattttaactgtaagctgtgagcaatgggctacaggctgcacaaaccgcaagtttggtgtggtataagatagcgtggctctcgtagcttatacaaagaatgaaagctatgaatacaaccgagtttgatgaaatccgtccttacaacgacgaagagctccccggagttttcgaagaactgattgccgatccggcttttcagaaagtggttgccggggtgataccggatgttccctttgagatgttggcacaaaagatgcgtgcctgcaaaacgaaactggaatttcagaagaccttctgttacggtctgctgtggaaactggcgggggagtgtactgatggtatctcattagatcatacggctattccggacaagagtaaggcatacacatacatttcgaatcaccgggatataatcctcgattccggcttcttgtcggtactgttagtcgaccaggggatggatacggtggaaattgccattggtgataacctgctgatttatccgtggatcaaaaagtttgtccgggtcaataaatcatttatcgtacagcgcgcactgactatgcggcaaatgcttgaatcatcggcacgtatgtcccgttatatgcactatacgattggtcaaaagaaccagtccatctggattgcacagcgtgaaggacgtgccaaggactccaatgaccgcactcaggacagtgtgctcaagatgcttgcgatgggtggagagggtgatgtagtggatcgtctgatggagatgaatattgctcctcttgctatttcttacgaatatgatccttgcgattacctgaaagcacaggagttccagttgaaacgtgatatagaggggtataagaagaccatggaagacgatctgaaaaatatgcagaccggtctgtttggttataaaggtaaggtacacttccagaccggggcctgcctcaatgatttgctttcgacagtggatcgttctttgcctaagcctgagttgtttacacgcatctctacatggatcgacgaacgcattcatggcaattatcgactctacccgggcaattatgtggctcatgacttgctgaccggcaaaaatgattttgagtcccattatacattggccgacaaacaacgtttcgaagcctatatggagaaacagcttggaaagattgagatacccgataaggatattccattcttgcgtgaaaagttgttgctgatgtatgctaatccgcttgtgaattacttagctgcacgtcaatgagaatatgggtgctgcatatcgcccgacttgtattgctctctgctttcctgatctcctgtaatgaagaagagggagcctcttaccctcctgtgaaactggagtttctgaccgctgaggcgggagcagacggtactttgcaaacattggtaacggataagggagagcgtctggtggtggcagaagaccgcacccggacggaattattcccgaatggaagtagccgcgtggtgagtaattatgaagtaatctcgtccgccggtgggcagaaggaggtgcggatttatgcattggccaatactgtatctcctgccccggtacccgctgcggagttcggaaatggtttgaaactggacccggttgatgtgctgagtatctggatggggcgtgattttctgaatatgaccctctccatcaaagcacaaagtgagaaacacaggttccatttcattgaagagtccgttgtgagggatgccgtaacagggcggttaactgtccgtttgatgctctatcatgataatggaggagatatggaagcctataccaaacgggcttatgtctcggtgccattgggccggtatgcggcaagtgctgccgaaccggcaatgatttatttcagcttgcatacgtatgacgggaaggtgaagacctatcagtttgagtacgtacccagtcactaatcattaattactaaaaagttgtgttttgaatttattatttaattctgtagagatgtgtatgattgtattgggtggagtatatttaagtgatattggaaagcgtttttgttattaaacgactttagatattattcttattttgtgttctcatttcaccatgtcttgagaatttattagtttatttatgtgtatattgtgaccattaaacgatatttgattaatcttaaaaaagaagcttatgaaaaagaacattttattggggagtgttttgttatttattatggttatcacattgggagtctctatatcaagaactcagaatgtgaattccgatttgttttctttggttggcgtggaacagctatcttatgctgaggttattggccctgttgaagtaacttgtagtggaggtagttctggtacttgtttcaaaatgggatatcaagagggattatatggtacttgttacttcttttgtacttttactggatatcaaagcgactattgtagttcttggtatgttaacttggtgaatttttgtacaataataggggggatctaaacgtatcgatataaaatgattttgagggttatgtataacttttgagagcagaaactatgaatttgagtaaaaagtgttaatatacaatgtgctaatgtattatagctttttactcaaattgttttaatatttatttctctgaggcttaaattatgaaaaatatacttgtttttattattatagcaatgggacttgcagcatgtaggcgttcgtctacaatcactccaagagatgtaaagggcataaagacagtaaatatagataaaaataatgtagtttctatctatgatattttttctaagatggaaataattcctttagagatgactgaggagtctgcattaggctatcctctaagaaaaattttagtgaatgatggaaattattatgttttagattacactcaaaatacaatctttaaatttgactcttgtggcaaatatttagataagattaataaattaggctctgctccagaagagtatactttattatatgatttcagttttaatccttataaccaaaatttggaattaatgtctgctatgggatatattaatatttatgatcattctggggaattttttaagcagcgtgtaaatttacccaaaacagtacattctattaactattttgcaaatttatctcccgacaaatatgttttctttagtaacacaaaagaaggtaataagattatgctttatgatataaaagagaaaaaaataacttctgagaattatgatgtaccaagttttatttttactaataccccttatcatcattcttatagtccattttatatgcataatgatactgtttgctttgtgcaagcttataatggcgatgtatttaccatttgtgaagatggaactctgaaacctagatttcaatggaattttatggaatataattttgatatttcgactcttaaagaggagtcgatcgaattttatgttaatcatagtcgtaacgtaagtagccattatgcaacatgttttttagcttatggtgagaattctgattattatataactcgttttagactgaagaagagatattaccatttgatattaaataaaaaagaagggacctgtctcacatttaattctttgaaggaggggtgtgactgtttcccgtttttaatggataataattatctctacttttatgtaagccctcgggaactaaattttgcattgaatccagatgtacttaatagtagagaccgattgaaatttgaaactgtaacttttgacgataatccaataataattaaatatacatttaaatgacagaaatgagaataaaagtgattttgttttctggccttttgatggctttttcgattttaataataacagttataatattatttatgtgcgcaaatattactcagaaaccaaaagaagaagataatcctgactttggaatagagagaatgtatattgaggataatatttatgaggccagtatgaataatggtttagagttagatttgccttggattcatttagatacagtatttgtctgctattattctgctcaatcatgtggcatttgtgttgagtatgctttaaataagataaaagagtcctttgagcctactgatatggggcaatgtgtatggtttttaacttctgattttaatcctaaaatgaaatttagtgaggaagggacaataaatcttggtaagaaaaaaagtggattaaaaatagaaggctccatgtatgtatgttattttttgctgataaatggaaaggtccaacatctttttatacctgaaaaaaaattccctaattatacagatatttatctgaaaacaatgaaaaaacgatatttctaggaacttgtttgaggaataatttctgagttgtaaaattgtaatataatatattgggctttaattaaatattgtttcctaacttcttgattattatgggataacttgatgtaaacacaatgggtattgttaaaatatggtaatcgaattattgacatctctttcgatgttgacaatcaactttggggaaagaaacaatatgcagcaatgctgctcagtagatttacaacaagatttgaaaagcttatgtttggaatgccctatttggacgatgttctttagttcatcattgatagtttcggtgatagattttttcttgagcaatattctgtcgtgaatgctcataggtgttctccggtgtgttgctgttgagtagggtaatcaattgtattcagttaataaacaactttttgaggagtttttgattatatgtcctttgttttcgataatgatcataggaaatcagatggagaaacaggtgagtcaaatgtgtgtatacatattgctgataataatgttccaaacgtctgtaatctaaggtatgaaccataatgagaattgaatcacctacggcattcttggattttggtgatatttctgcttttgagaagtgtttcagaatttatgttatatttttcaacagggtatcaaaaaactaacagaaatcatttgttaaacagaatatttcaataactttgttttcagcaaacatagcgataagagacttgaaaatgttataattaagcattataactttgcgggtattattgttatttatcaaataatcaaacgattaaatcctgttgaactcacgtcgttatagaatcaaacaattactaaattatatgtcgaaaatgaattcaatgcttatgggaatatggtttttattgtcatctctcttttcttgccagcagtcgaaaggggatttcaagacagtgccggtaaaggagtttgcttcactgattcaggacgagagcgtacagcggttggatgtccgtacaatggccgagtactctgaaggccatatcccggggactatcaatatcaatgtgcttgatgattcgtttgccgctatggcagactctacgcttcagaaagataagccggtagctttgtattgccgtagtggtaagcgcagcaagaaagcggctgtcatcctcagtgagaaaggttataaagtttacgaactggataagggatttaatgcctggcaggaagcgggagagaaagtagagaaataacgatcaacgatgaacagcaatcatgtgcaaccctgttcatcgttgatcgttcattgttattatagattttccaacagtcttttcaatactactgttgctgatatttcgcggtttgcagcttctgggatcacaatggattgcgggctctcgataacatcgtccgtcacaatcatgttccgtcttaccggaaggcaatgcatgaagtaggcgttgttggttacggccatttggcgttcgcctacggtccagttgcggtctgtactcaaaatctgtccgtagttgtcacctgtgtaggctgcccagttcttggcatatataaagtcggctccttcgaatgctttcatctggtcatattctacccgtgcgtttcctacaaacttcgggtcgagttcataaccttcagggtgggtgatgacaaattcatagtcagtggcattcatccattcggcaaacgagttggggaccgcctgtggcaatggacgcggatgcggtgcccaggtcattactactttcggacgggcagtctttttatattcttcgatggtgataagatcggcaaagctctgcaacggatggcgggtggccgcttccatggagaataccgggcgtccggaatgttgtataaactgattgatgattacttcgttatagtcgtactcgcggttctcgaagcgggcaaacgaacgtacaccgataatgtcgcaataacatcccatgaccggaatggcttccaacagatgctctggtttgtcaccgtccatgatgacgccacgttccgtttccagcttccaggctccctggttgatgtccagcacaattacgttcatacccaggttaagcgcagctttctgagtgctgaggcgggtgcggaggctggagttaaagaagatcatcaacagggttttattacgtcccagttctacatatttaaaccggtctttcttgatctcgaatgattcggccagggctgatttcaggtcgccgatgtcttgtacgcaagtaaatttcttcataattgtctttgttagaatgaatatacctttccgcaaaggtatgataaaattttcaattggcagactgtgcccatgaaagatactccgtttgccgtggggacaggaaagtgctgttggccagataatccttattattggcatagataaagagcacactgccctttttaatcgtgtcgattatcggtttggcaagtgcctgcggcagggcaggacaacccaggcttcgtcccaggcggccggcagaagcggctatgttagggttggcataagcggcgccgtgcattacgatggcacgttgtttggcttggtcattaattcctttttccagtccgttcagtaccagagagtagccgttgcgtccctgatatgtattttctgtcaggtaaaagccaagtgaacttttgtatgaaccgtttttattggagaaagaagttgcatagttctctccgctgtttctgccatgtgatacgacagaggtataaagcaatttcttattcttcatatcgagcacatagaggcgcttctcggtagatggtttagaaaagtctatcagcgtcatgatagacttgcttttctgctcgattttccggtagccggtgactgcctgacggaaggctgtatagcttacgataccatccaggtgcatatcgtcgaacagttgatccacttcgtccgtttcgggagtggaggcaacggatacaggttcactgaccggtacacggctgggtgcttctgccaaaggaagaagaaacaacaggagaaatagaaatactttttgcataggaaacagagaaaaataacggcgcaaagatacggatttctattccaaaacaaaaataattgtctcatttacaggtgcccaatcgaaaataaacttcgaatgtgaggtggcattccgtacacacatgtgcgaacggggggtggtgcccagtgacggactgtactcgatgagtgctttgcgtggctcgtttaccgggactccgtgaatgtatcctccgtccgagaaccggcttgcgtaaggtgcaaagcctccggtagcggtagaaccgtctttgaggaatatcatgcgtgcctttttctcctgcaatacgaagatgcctaacggggtttcctgtgcatacggcgggcggtgtcgtccggtggtggcggggttcatgctgcgtacagcccatcgggcctcaccggtttgttccagtgttgctatgttctggtctctccggtctatcatgattgctttggtgaaacgggtcgtatccgggagtactttgacgtatttcttgggtacataccactcttcgcctatgtagatgggagataccttgacgaacttttctccgtctgccagaaaacgtaccagcgaaccgtcttctccataacgttcgggtaccagtgtatcggtgagcagatagagcggaacggactggtaacgctctatgcccagggtgtcggcaatgcgtttgtaagcattccgtttgtagtggcgcaccaatggggcttcaccgttccgattcttatagttttgcaggataccccatcgagagggctcttgctggatattttcgagcagagccagacgttctttgatcttatcccactggaaactgcgggtggtatctttgtacgggtaagtatcttcaagggtatatttgtcgtagagcaggtctttcacaatctctatctgctctgccgagatagccttgggcttctcttcgggaggtgtttgttccagtgaatctgctacagcaaccgtttcgggctgtagcggatttgttttgttttctctgttgcatgcgcagaaaaggaagaggagggagaacaagtatatatgggctgtttgcttcataatgggatgggttaggggttcatttacaaatataatattttttataaggaatagcaaagcgttttgttttcgtattattaataatttgcatatttgccctatgttttgtcaagagcaagtttacacttctttaacgtgaggtcttgccggattaaactatttatacttttcggattttgcgcggaggagttatgccggatgtaaccgcgataataaggtgaagatgccgtctccggctccggaagcaaccgtcttcgggccggaacaccggctcttccggcacggaataccggctctgttgaggggaaacaccggctctgtctttcggaaatgcagcctttgaaaaaaagaaagggggaggcagcggcctctcccttttatcgcattctaaatagaatgtaatgtatgattgtatttacaaagatagcataatccgggggcaaagtcaagttttgaaccgattattttgcggatttcgcctgaataaagatcatcggcgcgtttgtccgtcaccttcgatgatccatttataggaagtgatctcttccagtcccatcgggccacgggcgtgcaacttctgtgtactgatgccgatctctgctcccaacccaaattgtgctccgtcggtaaacgccgtagatacattggtatatacacatgctgcatctaccatccgggtgaaaagggcggcgcgttcccgactttcagtgacgatgctctcgctgtggcgggaactgtactcttgaatatgtccgagtgcgtcttcaaaactacagactgtcttgatcgccattttatagtccaggaactctgtcccgaaactttcgggtgtagccggtttcaatcctttggcaggataatgtccttcaagtgcctgataagccaacggatcagcgtagataatcacattgcttgctttgagcttctcgcatagcgcaggcaggtcggacaatctgctcttatgaatgatcacacaatcgagtgcgttgcagacgctgacacggcgtgttttggcgttgtgaatgatggctgctcccttagtagtgtctccgtattcgtcaaaatatgtatggcagatgcctgcacctgtttctatcaccggtatggtggcattctgccgcacgaagttgatcaggctgctgctaccgcggggaataagcagatctacatatccggcggcatgcaaaagttcgttggtcgcttcgcggtcagccggcagcaactcgacggtgtgggtgtctgcatcaaacagccggagcacattatgtatcacttctacgatggcgcgattcgaaaagtcggcatcgctaccgccttttaaaatacaggcgttaccacttttcaagcaaagcgaaaagacatcgaaactgacgttaggacgtgcttcgtagatgataccgataactccgaagggcacacttacttttgtcagcttcattccgttgggccggatgctttctttcaggatcctgcccagcggtgaggggagtgtcgctacgttccgtatgtcggaggaaattcctttcaaccgttcttcggtcagtttcagccggtcgtatttcggattgtcgggtgacatccgatccaggtctttccggttttcggaaaggatatacggcgtttgtgccaaagcagcatccgctacggcgttcaatatccggtttatttgttcgtcgggcaataatgccaaacgacggctggctgcttgtacggcagcaaatgtatcattcaggttcatacgcaattcgtttattcgatgtacagatagtcataatggaccactgctttttttccatgctttccgatggcgtcccgtgcttgtgtcgagtcacagttggctttgcccacacctatgggaacgccccggttatcgatgatccgcacgatgtcatctttctcaaactccccttcgatgcgggtgattccgatgggaaggatgctgactgccttgtccgagttcaaaacttcggaggcttgttcattgatgtgtatctctcctttggcgaaaccttcgctgtgggctatccatttcttgatactcgacaccggctgtggggcggggatgaaacgggtgcaaatggtttcttccggatgttccgtcaggttgatgagtatattgtcacgtttgccgttggcaatgattacggtaataccttcgtctgccactttgcgggcaatgttggttttagtcagcataccgcccctcccaaaactcgatttgctggtctggatatagtttgtcaggtctttcccttgccctatttcccgtatcacggatgaagccggatcggcaggagaaccgttgtatatgccgtcaatattgcttaggatgataagagcctgcgcatccatcattgaggcgatgagtcccgataattcgtcgttgtccgtgaacatcagttcggtgacggagatggtatcgttttcgttgacaatggggatgactccgttctcgagcattaccgtcatgcaatttttctggttgaggtaatgccggcgggtaccgaaattctctttggtggtgagtacctggcctacggcgatgccgtgatcacggaacaattcgtaatatcggttgatgagtttggcttgtcctacagcagaaaataactggcgttggtcaacgctgtcgagtttcctgagggtgcgtatttcacttcgtcctgaggcgacagcccccgaagagataagaatgatttccattccggctttatgcagggcagctatctggtcggttagggcagacatccgggtgacgtccagcgttccgtcttgccgggtaagtacgttacttcccacctttacagctattcgtgtaaactcctttttcattatgctaacgatttgaaagcacaaatatatggatttttgtcgaaatgtaacctaaggggtacattaaatgaaaggtcttatcatccaggtgcctaaagagagggattaggtgccggtagtacatacctctcccacgtgggtatgcctgacggacatgtctgcgtgggaggagaaaaaatgtttggtgatttattcgttcgccttttcccggtttctcactatttccatagcctgctcgtaatcgtcttcattgacgaggacggctatttcctgtccgatgtagtaaggtgccagagccgcaaggccgcctccgtccttcagaatggattctattccattgctttcaagtaatcctttggtaaactctgcttcccaaggcgaaccggtgaagacttctactaagcgggtgtctttatcttctttcataatggtagggatattatgtggttatctcctacaaatataacaaaaagaacctggataatgttgttttacatatagattattccaaagatatccgttgtaccgtaatgtcttggttgaggaatgttgaggccgattcaataaatttatcttcggcttctgtggtacaaaagctgcaactgcctccccgagtgcatttccggtccatttcggggtgcctgtagaggtaatctttcaggctggcggctacatattctccctgtgcaaccactttcatactttggggcacgaactgttgtatcttgggcagcagcagcgggtagtgggtacatcccaaaatgatagtgtctatctgtccgtctttggcaagcaggttgtggatgtatttacggatgaaaaagtcggttccctcaccattggcttcgttgttttcgaccagaggtacccacattgggcaagcttctccacttacttttatgtccggaaagagtttatgtatttcgagcggatacgattccgatttgatggtgccggctgtggccagtactccgacatggcgggtttgggttatgctgccgatgcactctaccgttggacgaatgactcccaggactcttcggctgggatcgatatccggaagattgttcatttgtatggttcttaatgccttggccgaagctgtattgcaggcaagtatcactaagtggcaacccatctcaaacagtttgttaaccgcctgcagggtaaattcatatacgatttcaaaagaacgggtaccgtaaggggtacgggcgttgtcgcccaggtagatatagtcataatccggaagagcctcccggattttactcaggatggtcagtccgccatatccggagtcgaatactccgataggaccgggtttctgggaaagggattgtttcataacggagatgggttaaaatgttacgagctacaagtgacaagtcgtagcgtattttccgcatagtacttgtagcttgtagctcgtaactttatagcttccgactcttatttaatgcccaattgggtctttactttcggagtcaggttgatgctctgattttcgttaatgtaaggtatcggagtacgtgccatgtcgaaaatgtagataacaccttctgctgcgcctactgctttgatagcatcgtccagcttcttgtataccggagccatcaggtcgttattagctttctccatatcctgttgcgccttagcctggaattgttcttgtctctgcatcatgtcttccagctctttttgtcttctttctgcaatcacagtaggaagagagtctttctgctgcatgaactcctgatattttttgttgaattcttcttgagttctctgaaggtcctgtccgagttgtttgttcaatgcctgcaattcagattgtgctttggtgtattccggcatagccgaaacaatttccattgcattgatgtgaccgaatttaagattttgtgcgaatacgcccatcgggagtaccagcatcattaaaagtgcaatttttttaagcatagttctattatttatttgaatgattactttttagttatcggctgcaaatgtatgaaattaatttgaatatcctaatttcgccagcacttcattgctcacatcaatgcgcggagtggcaaaaataatgctcgaagctgaagctctgtccactactacagcgtagccgttttcttcggctactacttttacggcattgtatatttcatcctgaatgggcttcatcagttcttctctcttcttaaaaagctcgccttcgggaccaaagtacttccgtttcaactctgaggcagccttttctttttctacgatggcatcttctttttgagttttctgcgcagccgtcagctttgcagatgcagcttgatattctttaaacatggtttgtgcttcctttgccaatacttcgacttcaccctgccattgtttggtggcttggttcaattgttcgttggcacgttcgtaagccggaatgttcttcaggatatactccatatcgatcagagcaaacttttgtgcttgagctgtcatacctacggcaaacagcaagatgataaatagaacagactttttcataacgcttagtttttaatgaaacaattagaattcctgacccaatacgaagtggaatctgcttccgcctgcgctcttgtcgccaagtactttgtcgaaaccgtatgcccagtcgatacccatcataccgatcatcgggaggaagatgcggacacctacaccggccgaacgtttcaggtcgaacggattgaagttcttcacatcatgccatgcattaccggcttccaggaatgttaacgcataaatattggtacttgtttccagcatcagcggatatcttaattcaaatccgatacgagtgtaggcatatccttcctgtccacggtacggagttaacgaactgttttcgtaaccacgaagggcgacactctcggttgcatagcttgaatatccggtcataccgtcaccaccgacgtcaaatgtaccgaacggagatttcttatatttgttgtagtggcccaatataccgaattccacacgtgtcatcagcaccggagtctttttcacggttgtcgggttcagcaacggaatatatgtttttgctttgaacttccacttatggtattctacccatttgtgcattttgttcatatcgttctggttgtactcgttatatttactgtagtctactccgtcgaacagtgagtaaggcggtgtgaactgtacagacagagagaagtctgaaccactacgcggataaatcgggttatcgtaagaagcacgggccaatgtcaagccgatgcttaagtcgttacatttaccgttagttaccgggaagtactgccagtctttcaagatatatctttgataagaaagctcggctgaaagctggaagtagtcatctggccagttcaggcgttttccccaacctgctgacagaccccacattttgattgacttgtcagggtcataatagttttcgtagttgttatagttaccataattgtacataccgtaaccgcctaagccgctgtaataactgttgtagtaattgttatagtagcttgagttatagtaacggctgctgatatcagtctgaactgagaagaatgccgacagggagaatgaattcggacgtttacctccgaaccagggatcaaagaacgaaatgctatactgctgatagtattgtgcattggtctgtccactgatggtcagtgtctgtccgtcaccctgaggcaggataccacgatagttttctcccgggtgcaataggtttgccaaagagaagttcgtaaatttcaaacttaatttaccgataacacccgtctgtccccaaccggcagagaactctacctggtcatttgctttggataccagatcataggcaatatctaccgttccgttcacttggtccggctgaatatccggtttgatgttttccgggtcaaagtgtcccatttgttggatctcacgcatagaacgcatcaggtcctcacggctgaacaactcgcccgggcgggtacggagttcacggcgaacaacgttttcgtacaaacggtcattaccattgatcttgatcttattgatgctggcttgccggccttcgtagattctcatctccaggtcgatagagtcgttgtcgatattcacttctaccggatctaacgtgtagaacagataaccattgttgtaatagaggttaccgatagcgtcttcatcggttgacaaacgttcattcagcaatttctggttgtatacatctcctttcttcatgcggagcataaagttcagttgttctgagggataaagagtgttacccacccatgttacgttgcgaaggtagtatttatcgccttcctccaattcaatgtatacatctaccgttttatcgtcaaatttggatacgctgtctttcacgatacgtgcatcgcgataacccagttcgttgtacttatcaataatcagttgcttgtcctcttcatacttctcattaacaaacttcttggtgcggaacaagttcagcagttttcccttttcgtttgttttcttcatcacacgtttcagcttcgatgttttgatagcatggttaccggcaaaagtaatggcatggacttttaccttttctttcttatcgatatctatgtcgaccaatacttgattttcatttgcaggatcatctctttgagtaatggttatttctgcattcttaaatcctttatcgtcgaagtagcgtttacttaaaacctttgcacggtccaccagattaggagtgatctgactgccttttatcatacccagtttggtctgtaggtcttcacgctccgactttttcacaccgtgatagcgtatgtctgaaatgcgcggacgttgagtcagactgatcttcagccagattttattgccttctatcttttcggctgtgattgacacgttggagaacagaccgtgacgccagtagcgtttgattgcccccgtgatctcatcacccggtacggtaatagtttgtcctacagaaagtccggacagtccgataagaacataatcttcgtagttcttgacaccttcgaccttgatgtcggctatttcatattttttcggtgtcccggaatacatgataacgggttttgattcgtcagtgttagcatcttgtgctacgcccggcaatgcaaagcaaaacaggctgataaacgttacgaatatgaaggaaatacgataatgcatttatgttataattaagttttgagttaactgatttgttcgctggtctttccgaatctgcgttcgcgtctctggtagtcacagatagccttgtgcaattcttcttccttaaagtctggccagaaggtttcacaaaaataaagctccgaataagcacattgccaaagtagatagttgcttaaacgaatctctccgcctgtacggattaagaggtccggatcgggcatgaaattggttgtcagatgcgtctggatgctttccgaagtaatttcttcaggagtcatttctcctttctgaaccaatgtggcaatctgccgtgcggcctcggttatttcccatctggcagaataactgagggcaagtaccagacacattcctgtgtttttggaagtacgttcgacacaggcattcaagcgcttccgtacattttcgggtagtttgttgatgtctccgatgatacggaaacttatattgtttttcataaatgtttcctcttcgatagagtcgaataggaggctcatcaatgcagcgacttcgtccgatggccggttccagttttcggttgaaaaggtatataaggtaaggaatttgactcctaacctggctgcctcttcagtgatgatatgcacagtttcggctccggcctgatgtccaaaactacgttcgcgtccgcgttgtttggcccatcgtccgttaccgtccatgataatggctacatgcttaggtatccggtttaaatctatttgttctttataggacatttctttaattatttgttctgtctggcaaaaccaaatttattaagtcgtccacgccatacttcgttggcatcgccgttactccatattacccagataaagttatctttgtccactacagtagagtagttgttccctctgtctttgaattcagtcggtaagaagattttcttatcggctttataccaggcaagtcctgcttccgatgtgtagatcgtttcgaactttcctccgaatgcccagaaagcgttgccataatagaagaaagacggtttgtcgagcttcggacaataggcagtggtcgatgacgtttttaaaggaatccaaagtaaaccgtcctgtgaactccaggccaccgaagttgtatcgcttgcattgcgattattgcccattacggctattgtctgtattcctgtagcattgagataagacgttgctgacaaattatccagcgggaagtcagaaccgacttcttctgaactgatattccatgcggttgcttcaggattgcttatcgcaaatgtagattgactaccattattaataataccggcaattccggagatatccagcagattgccctcattcttggggaaaggagcgatcagcatctctactttaccgtttttattcaaatcggttgcaagactccatgatgccccatctgaagaaacatatactttctcaccgtttgtggcatacaatttttcaccaaaagctatgagggaagagagttttatgttttccggaagcccggtaacagatacctgtgcccaacttcttcctttgttgattacgtctcctgatgatttgtagacagtagtgtttgctgtatacacaagaatgtcttcacccagaattacggacttctgatacccactgtagttagcaaagttatctgtcattttagtccagttcatggagtccggatcctgtcggtgtacgcgcactgaaatggtgtactctttggtatattgcatatccgcggcccatacctttattctcatgggcttttccatagtgcccctgaagtcaatagagtcggagtaattaaacaaggtgtcttgaccctctgcgtttttagccgtgattattccggacgctgtggtcaatgtctttataagaatacggtcaataattgtatcggagcccacaggcagtgaatcctggttataaataagtccaactccgtcaggtccaaattgatctattgtaaatttatagtttaccccatgtacggtatcaagtgcaaatgcatgtatggtagcatccgggctgtattcaatttcttcagtgtcaaggcacgaagtaacggcaaacgatacaaggaagaaacttacaattactgataaaaactttattctcatttgaaagattgtgtttatttacaagttgcaaaaataggaacatttttctctatattgaacattgaagggaagttttatataaaattatagataatctgctcgattttgtcgatataaaactccctgaatgctgcgaatttaggtatttctctttaagtaatgcctgaaggttgtagcgaaatgtttttcttctgaataactaattttatcgcttatttcaggtgctttaacaccggaataaagccgtttgtcgcttctttctataataatttcatcccatattccggagcagataaatgattccagcaatatcttgcctccttcgaccatcaaggattgtagattacgctgatagagggttgccagtatttgtggcagaatatctgtttgatagtccaaggggatatattccagattctttttaccggggcggtggcattctgtaaaaatgagtgtaggcacgctaccatccaaaaggtgtgaagtctgaggaagcgaatgattacggtccagagctatgcgtaccgggttatgtccgtaccagtgacgtacagttaatgccggatcgtctaataatgctgttcgggtacctaccataatagcatccgattctgctctttttttatgtaccaacatggaagtgaggggagtggataatagcacaggatgtccttctgtacgctctaagtcgatgaagccatcagccgattctgcccattttaaaacaatataagggcgatgaagggtgtggaaggtgatgaatttctgtataagttcgcggcactccttttccaggactcccactatgacctcacgtccggcattccgtaatttttggatgcctttacccgcaactttggaaaatgggtcctggcaaccgattacgattttgggaatttgcttttctatgattaggtcagcacagggaggtgtctttccatgatgggaacaaggctcaaggcttacgtatatagtactgcgtttcagtaaagaggggtctttaacagaacggatagcgttgacttcggcatgggcttctccacaacggacatgataaccttcgccgatgatttgttcatcacatacgatgacggcccccaccattgggttgggagatacgttgcaaagaccgtttcttgccaattggatgcaacgtctcatgtatttttcttcttccatcttttaggcttatagctatattatttgtatttttgcaccccaaaataatgagaatgaactgcgtcaccacttatatccgccagtctttacaccatatttatccaccgggagaactcaggagcctcacaaaaatgatttgttgtgatctgctggggcaggatgctattgactattatttgggcaaagatataattttatctgcaaacgaacagcgtgatttagaaagcattgttgaacggttgaagaaaaacgagccaattcagtatattcagggaagggcaaatttctacggatccatgttccgggtagctccgggagtcttgatccctcgtcccgaaactgaagaactggtggatttaatagtaaaagagtctgctacaggtgtccgtctgcttgatataggaaccggaagtgggtgtattgctataagtttgtctaagcatattcctggagtggaggttacggcgtgggatgtgtcggaaaatgcacttgccattgccaggcaaaacaatcaggaactgaaaactaaagtgaattttgagaaagtggatgtcttttctacggagttttctggagacagacgatatgatattattgtaagtaaccctccttatgtgacagagagcgaaaaacatgaaatggaacctaacgtcttggattgggagcccggtctggctctgtttgttccggataatgatcctttattattttaccggcgtattgcctctttggggagagagatgctaagtctgcatggtaaactctattttgagataaatcgggcgtatggtgaagaagttttgcaaatgcttggcggaaagggatatagagaccttcgtttgataaaagacatatcgggtaatgatcgaattgtaactgctaaacgatgaatataataacagaagaagatgcgttaaaccgcatggctggctattgctctgcagccgagcattgtaaagctgaagtgagtgaaaaactacagaagtggggcttgccttatgaagcggtcaatcggattattgatcggcttgtggttgagaagtttatagatgaagaacgttactgtagggcatttgtcaatgataagtttcgttttgccaaatggggtaaaatgaagattgctcaagcactttacatgaaaaagatatctcgtgaagtgtcttataaatacctgaatgacattgatcaggaagagtatcttgctattttgggagatttgatggctgctaaacgtaaaagtatacacgccaaagatgaattcgagttgaatgggaagttgatccgttttgctatgagcagaggatttgaaatggatgatatccgccgttgtgtgcaagtggaagaagagtaagtgacaaataacaaaaaaataatacggcttcttctttttagtctcgttccatttccgtatttttgcatcctgtaattatcatagttagtttagttatgaaaaatttagagagattattcgccgagaagttgttgaagattaaagctattaagcttcaaccggcaaatccgtttacatgggcttccggatggaaatcaccgttttactgcgacaaccgtaaaaccctttcttatccttctcttcgtagttttgttaagttcgaaattacacgtctgattctggaacgtttcggacaggtagatgccattgccggagttgcaacaggtgctattcctcaaggtgctttggtagctgatgcattgaatcttccgttcgtgtatgtccgttctacccctaaagaccatggcttggagaatcttatcgaaggcgaacttcgtccgggtatgaaagtcgttgtagtagaagatttaatctctaccggtggaagcagtttgaaagccgtagaggctatccgtcgggatggttgtgaagtaattggtatggtagctgcctatacttacggattcccggttgccgaacaggcttttaaagatgctaaagtacctttggtaacgttgactaattatgaagcagtgttggatgttgcattgcgtaccggttacattgaagaagaagatattgcaacgttaaacgaatggcgcaaggatccagctcattgggaaaccggaaaataagactgatttttttgatgattaaaatatagaaagaagggccattcggacagagtttgttcggattgttcttcttttttctttataagtaagatagaataagatgactaaatttgagagtagtgtcaaggtaataccttatagccaggaacgtgtgtacgataaacttgcggaccttagtaacctggaatccataaaagaccgtttaccacaagacaaagtgaaagatatgagttttgatacggatacacttagtttcaatgtagatccggtgggacagctaacccttaagattattgaacgtgagccctgtaagtgtattaaatttgagacgattaattctcctctgccttttaatatgtggattcagattgtatcttcagccgatgaagaatgtaaacttaaaataaccattgggttggatattaatccatttatgaaagcaatggtacagaagcctttacaggaaggactggagaagatggctgatatgttatccatgatacaatattaaagaatatggcacagaaactttgggagaaatctgttgaggtaaacaaggatatagaacgctttaccgttggtcgtgaccgtgagatggatctttatcttgctaaacatgatgtacttggttcaatggcacatatcactatgcttgagagcataggtttattgacaaaagatgaattatctttattgttagccgaattgaaagatatttatgtttctgccgagaaaggtgagtttgtaatagaagaaggagttgaggacgttcactctcaggtggagttgatgttgactcgtcggttgggagatgtgggtaagaaaattcatagtggtcgttcacgtaatgaccaagtattacttgacttaaagctttttacccgcacacagataaaagaagtggcagaggcggtggagcaactctttcatgttttaattcgtcagagtgaacaatataaagatgtattaatgcccgggtatactcatttgcagattgcgatgccctcgtcatttggcctttggttcggggcatatgccgaaagtttggtggacgatatgctctttttgcaagctgcatttaggatgtgtaaccgtaatcctttgggatcggctgcgggatatggttcttcatttcctttgaatcgtacgatgactacccagttgcttggttttgactctttgaactataatgtagtttatgctcaaatgggacgtggcaagatggagcgtaacgtcgcttttgcactggcaacaattgcaggaaccatttcaaaattggctttcgatgcctgtatgttcaatagccagaattttggttttgtgaaactgccggatgaatgtactaccggttccagtatcatgccgcataagaagaatccggatgtgtttgaattaacacgagctaaatgtaataagttgcaatctctcccacagcaaattatgatgattgccaataacctgccttccggatattttcgtgatctgcaaattatcaaggaggttttcttgccggcttttcaagaactgaaagattgcttgcagatgactacatacatcatgaatgaaattaaggtgaatgaacatattcttgatgatgataaatatctttttatctttagtgtagaagaagtgaatcgccttgcacgtgaaggtatgccttttcgggatgcttataaaaaagtaggcttggatattgaagctggtaacttctcgcataataagaaggtgcatcatactcatgaagggagtattggtaatctttgtaatgatgagatatccgctttgatgcaaaatgtagtggaaggctttaatttctacagcatggaacaggctgaaaagaccttgttagggcgtgtttgatagattattgctatgtgaagataacttctatctttacatagcttttatgataaaaatagttttccgtttctttgagatttttttctttggaaaaagtttggcagaaagcaggaaactacttatctttgcacccgttgaaaaaacgcggaaatagctcagttggtagagcataaccttgccaaggttagggtcgcgagttcgagtctcgttttccgctctctttgaaaggatgctcgaatggtggaatggtagacacgaaggacttaaaatcctttggccattgcggctgtgcgggttcaagtcccgcttcgagtactatagttgcatcctaaaaagctccataagtaatgaacttatggagcttttactttattcatggagatgttatctatatgcagttagttatgcaataaggataacattcgcatgcattgatggacagttctctctatgttgctgcaggtccttgatttttccatagcttgctcttgagagaccggaccttctacaataggatatacagccagaaaacctgcattattcagcaattcggtttcatccacacatccggcaataccaattacaggaatattttttcgttgggctgctttgagaactcccataggggcttttcccattatagtttgggcatccattttcccttcgcctgtaatcacaagatcggctccttgtagtttctcattaaaatggagagcatccaatacagtgtcaattccccgggataaccgagcgttgaagaaggctataaaagcgccacccatgcctccggctgctcctgctccaggggtagcatcaatatccttatatagggtttgggcaatcaactgtgcaaaatgcttcagtcctgtgtctaatatgcgtatttgttttgcatcggctcctttttgggaagcaaaaataaatgcggctccttgtggtccggaaaatgggttgtttacatcgcatgcgatggtgaatgtacactttgccagtttatcttccgggaaatcgttgctatcaatcatctctatcttttgaagtatttctcctccataccctaataaattcccggctatatcccggaacttcatgcctaatgcctgcaacattcccgtgcctgcatcattggtggcactacctccgattcctatcagaaatttcctgcaaccgtgttccaaggcatcctgtattaattcgcctgtaccataagtggttgttttcatcggatttctcagatggggttcaatcaatgtcagtccactcgcggctgccatttcgatgacagcagtttctccatctcccaaaacgccataccgggcttctattaaccgcattaatggatcgtgcacgtgacacgaatgtatccgcccatttgttgcactgaccagtgcttcaattgttccttctccgccgtccgctatagggagttttatgatttcgcatttcggaaatacttttcgaatacctttttcacatgatacagctacctctgcggatgacagggaacccttaaacgagtcggatgcaatgattatctttttcatgcttggagaaaattgtttttatttagaagatgtgataataatcataagaagcgttgaaaataaaaagccggaatgtaacacgaatcattccggcttttgtccctaatcaaacctaatctaacaaacctatgaagctattctgttgctgataacccgcattgctgcagtgtaatattcacaggggacagaaagcagtatgcaatctattcctttgtccttcatcaccacttcgatagatgcagcctttagaagggttctcacacttgccacttcccatgggctaccagcgaatacttcaacctgagaaatctttctacttactaccatttgctttttagttattaaatgaatatgctgcaaatatagcaggttgttttctttcagaagagcaattttagttcatattatagcacttatgttgcaaacgtttgctgatttgttggtttggtcaatattttatgtacgaattttgtataattgggctatttctcatcattcttacggatttccacccgccggattttgccactgatagttttgggtaattcatctacaaattcaatgacacgtggatacttataaggagccgttacttttttcacatggttctggagttcttttatcaactcttcacctgcacgttctttataatcttttgccagcacaatagttgcttttaccacttgccctcgaatttcatcgggtacaccagtgatggcacactccactacagcagggtgagtcatcagcgcactttctacttcaaacggtccgatacggtaaccggagctttttattacgtcatcggcacgccctacaaaccaaagatagccgtcttcatctttccaggccacatcacctgtataatagatgccgtcatgccatgcttcgtgtgtacgcgcagagtcgcgataatactctttgaacagtcccaacggtttaccgttagtagtccgaataacaatctgtccttgttcgccagcctctaccgaacggccttcatagtctatcaggtcaacatcatattgggggttagggactcccatgcttcccggtttcggttccatccaggggaaggtggcaaccgttagtgttgtttccgtttggccgaacccttccatcagtttgatgcctgtcagtttcttaaatgtatcgaatactgccggatttaatgcttcaccggcaatcgtgcaatattccaaggaagaaagatcgtatttggtcagatcttcgtgaatcagaaaacggaagattgtgggaggggcacaaagtgaagtaacatggtagttttgtattttctccaatatgtcggctggagtaaacttctcgtggtcgtagacgaaaacattagctccggctatccattgtccgtacagctttccccatacagcttttccccaacctgtatcagcgatggtgagatgaaggctgttctctttcagattgtgccagaaactaccggtgacaatatgtcccaacggataggtgaaatcatgtgcaaccattttgggctcaccggtcgttccgctggtgaagtacatcaaagagatatcatcgttggagttgggatgttccggtttagcgaaaggggctgcatctttaatgccttgatgaaaatcttcgaatccttctgctatttcagggccaacacttaccaaatgtttcactgtaggagagtccggcatggcatctatgatatgtttagtaataacctcttctccggctgctacgatcatctttatatcggctgcattgcagcgatatacgatgtctttcttggttagcaggtgggtggcagggataacaacggctcccagcttatgcaaagcgatgatgctgaaccaaaattcgtaacgtcgtttcaatatcagcatgaccatatcaccatgtccgatgcccagactttgaaagtaggatgctgtctgatctgtatattgttttatatccgcaaaagagaactggcgttgttcacctttgtcattggtccataacaaagccggtttgtctggctgttcagcagcccaggcatctactatatcgtatccgaagttgaagttttccggaacatttatctttaagttcttgacaaaatcttcctgtgaactgaaggaagttttcgataaaaatctatctatcattttcttcatttaaataattacatgattactgccagaaaacgcactgtttttccatccagtgctttcattccatggggcagttttgagttgaagtacaagctgtctccttcgtttagtatcaggtcttttccatctatgctgatcatcatgcgaccttcaagtaccaagttgaactcctggccgccatggctattatagtgtatcggttcgttgtccggttttggttcgacagttacgataaacgggtcggcgtttcggttcataaagcccgccgctaatgattggtatttatacgcctttgtacgttctatactggttcctttacctgcacgggtcaggaaatagctgctcatcttaggctcttctccgaacatcagagcatcaagagctatgccgtatttacgtgcgattttttgcagcatacttactgagatgtcgtaatctccggtttctgcaagacgatattcttccgctgaaatctcacaatcacgggcgatgtcttcagctgtcagttcaagtacgtcacgtagtccacgcagacgttctgctatttgtttaatttggtcgtccatataaatttagtgtttagtgattaatgtttttgttttttgtgattaaaattagataatcactatcttgatgctttcattgctttaataatggcagaggtaaatccattatgctctaactcattgatacctttgattgtaattccgccgggagtagtcactttgtcaatctctacactcggatgggtatcgttgttcagtatcagttcggcagccccttttacagattgcgcaatcatatccatggcatccgacgggcggattcccatttcaatacctgcttgcatagcagcctgaatatatttcagtacataagcaatgccacaagaggttagagcagtagctgcttccagcttgtcctcaggcaaaatcatagccatccccatctcactgaagaggttgaccatcagtgtttccagatcgtgtccggcatttcgtgaagctatcagtgtcatactttgtagttcgctgatagctgtattggggacaatacggaacatgggcatctctggttcaacgacatcatgcgccaattgttcgaagctgattccggctgcaacggaaacgagaatctgtttgctttttagtttcatttcgcggagcacacttctgattagccagggtttcacggtcaaaatcacaacatcagcaccgatagcagcttctgcattattgcgagtggtagtgatagaagggaattcttttttcaacgcttccagttttccggcactggggttggacactataatatcggaagccgagatcagcttgccttttgccagtccgcaggcaatggagcctcccatatttcctgcaccaatgatagctactttcatattttataattatttagtctgtttctgacaaaggtataagtaaaaagtgaaaatacgagcaaacgtggcaggtattttcactttttcactttccttataaggatgctgattattaaccgagtacttttcttagccggacaaggaattcatcggcttctgccttgctgaggcagagaggaggtagcaaacggattacattcgtaccactggcaccggtaaatactttttgttcgtgaatcaggcggttgcggatttcctttaccggttggtcgaactccattccgatcataagtccgcatccgcgaacttctttgatttctctgaattttttcaattcttctaacagataggtaccaatgtcggctgcattttctaccaacttttcctgttcaatgacatccatcaccgccagtgcagcggagcaagccagatgattgccaccaaaagtagtcccgagcatgccatataccggtgtgaatatcgggctgatcagtacccctgccattggaaatccgtttccaatacctttggcaacagtgattatgtcaggtttgattccggcatactggtgggcaaagaatttgccactacgtccgtaaccgctttgtatctcgtccaaaatcaggattgtgccgttgtcagtgcaggctttacgaagttcctgcaggaattcggttgttggtattttgataccgcctactccttgtatgccttcaataatgacagcacaaacatctccttttgccagttcggctttcatcgcctccgtatcgtttagcggaaggtaggttatatgcccgttggcattgatcggagctataatcttaggattatctgtagcttctaccgccagcgaagtacgcccgtgaaaagctttgccgaaagatattactttggtccgtccgttatggaacgaggccaatttcagtgcattttcatttgcttcggcaccactgttgatcaggaatagggagtaatcttcatatccggatagttttccaagacgttcggctacctgttgctgtaacttgttgattacagaatttgaatagaagcccagtgttgccacttgcttgctaatcatgtcaacataatgcgggtgggcatgtccgatcgagatgacagcatgtcctccgtagagatccagatattccgtgccgttttcatcccaaacgtgacaaccttttccttttactatgtttatatcaaaaaggggatatacgtcaaataggttcattgctttttagaatgcagagggtttaaggcgcaggcctaccgtctcctccagattaaacatcaggttcatgttatggactgcctgcccggatgcacctttcaacagattgtcaatacaagaaatgatcaatagtttatcaccgtgtttttccaggtgaatcagacatttattggtatttactacctgtttcaggtctatgtttttgtctacgatgtgtacaaacgagtctttggaataatattcctcatacatgcgtacaatttcctctaatgctacctttgtttttacgactaaagtagcaaaaataccgcggggaaaatcaccccggtaagggatgaagtcaatttctgaatcaaaactattctgtaattgtttcagtgattgcctgatttcgggaacgtgttggtgttcaaaagctttgtacacgctcatattattgtttcgccaactgaaatgactggtggctccaggttttactcctgctcctgtgcttcctgtaatagcgtttaccattacatctccgtttagcatcagatgttttgccaatggaagtaatcctaattggatacaagtagcaaagcatcccggattggctacatgttttgctgtgcaggttgcacggcgatttaattccggcaggccataaataaagtcatgatccggtgaagcaatgcggtagtccattgataaatcaatgattttcagatcctccggaatgttgtgactttctataaatttctttgtatctccatgggcggtacagaagaaaagcacatcgatgtcttctaacgggagttcgtcggtaaagaccagatcgcactctccgtaaagtccttcatgcacatcggtaattttgtttccggcattactggtactgttaacgaatatgatttcggtttcgggatggttgataagcaggcggataagttcgcctgccgtgtatcctgctccgccaattattcctgcttttatcatacttcttcgtctttatggttagcatagtaaacacgtagcggggtagaagttactttgatgaagcctttagcgtcttcggctgtccaacccttttgcatttctccatattcaccaaatttggtttttaccagatcgtcttgtgactctacaccaacggtagagaatgacaaggggcggagttcaaggattgcagtaccgtttacattgcgttgagattcctgtagcattgcttcaatatcacgcattaccggttccagatactggctttcgtgaaggaacatgccataccagttggctacttggtctttccaatattgttgccatttgctcagcgtatatttttcgaggaaccggtgtgcgccgatgataagcatcggggcagctgcttcaaatccaacacgtcccttaatgccgatgatggtatctcctacgtgcatatcacgaccaataccgtaagctgcacctatttcttccaccttctggatggctgcaatcttgtcttcaaagacttcaccgtttacagcatgaagctcaccgtttttaaattcaaggcgcagtagttcgctaccttctttggtgacttgtttcagataagctgtttcgggcaatccctgtgcgctgtccagaatttctcctccgcagatggaagtaccccataatccgacgttataagagtatttcagcttcgtaaagtcggcttcgaaaccatttttgttcaggtaatcgatttcctcctgacgacttagggccatatcacgagtcagcgtaatgatttctacccccggagtcatgacaaggaaagtcatgtcaaagcgaatctggtcgtttcctgctccggtagaaccatgtgcaatggcttctgcgccaatctccttggcataacgtgcaatggccagtgcctggaagatgcgttcggagctaacagaaatcgggtaagtgccattacgcagtacgttgccgaatatcatgtatttcaaactcttttcgtagtattcctgagtgacatcgagggtgacatatttcacagcacccagtttgtaggcattctcttcgttctgcttcagttgttcttcgctgaaaccgcctgtattggcgcatgcagcgtacacttcatatcctttttccttagccaggtacattacagtgaacgaggtatcgagacctccgctgaatgcaaccactactttctttttctgttccatagtgctgtattttttaaatgttatttctttcttgttcctttttaatgttatgcggatctgccggatcatatagcatggcggtgcaaatacagaatttacgattctttgccaccaggatttcatggttagtgcaaccttcacatcctttccagaaagcttcgtcatcggtcagttcattaaatgtgaccggtacatatcccagttccgtgttcattttcatcacggccgccccactggtcaaactgaatattttagctctcggccatcgtaaacgagccaactgaaaagaggcctgtttgatacgtttggccaatcctaatccccggaagtcgggatgtacaatcaatcccgatgtagcaacgtattgtttgtttccccatgattcaatataagtaaatccggcaaacacatctccactgagggctatgattgcttttccttctttcattttggtggctacgtactcatgtgtacgttctgctattccggttccgcgtacttttgctgcgtttctgattgtctccaaaatagtgtcaacgtaaacctcatgcgaggcgtcggctaccataacatctatttgttgagtgtccatttttgatttagtgtagagtataattgttgttagttagttgatattcggaataatgagagacaagaaacttcgtacggcagtgggagtcactccttcgcgcagcaccagcatgatggtatcgtctccggcaatcgttcccagaatggtatccgactcacggttatcaatgtcgtaagccatgctgctcgcgtatccggggcgggttttgattactgcaatatttccggagaactgaagggagatgaatccgttattcattaacatttcactggcactttggtcgccaacccgtttgtacatgatgtcattgggcaatacatatacatatttgccattcatgctggcagctttggctactttcagttgtttcaggtcacgtgaaagagtggcttgtgtcagttcgaatccttcctgtcctaattcttgcaagagttcttcttgtgaacctacttctttactggagataatcatttttatggcatctaaccggtttgctttcttcttcatcttgtataattattctaagaatggcgcaaaagtatgcaataatttggaaatagtatgcataaaaggctgtttttttactctttttatacataaacatagcatatgttgtggaaatatgcagaaatagtagcatgaatatatctatgcttgaatggttatgtagtttttatgaattgctgaattctgattagaagtgatatataaataaggtgaagatatatttctatggaatcagaactgattgggaggtggatagttgtatggaaaggaagattaggaaaactgttgtttttaatataattcaattattcctctaaaaaaaacagacaagccgctcaatttgaacggcttgtctatgcgaatgtcggaatgaggcgactcgaacgcccgacccctacgtcccgaacgtagtgcgctaccaactgcgctacattccgctatctgcaaagtggtgccaccaggaatcgaaccggggacacaaggattttcagtcctttgctctaccaactgagctatggcacctttgtgattgcgggtgcaaagataggtataatttttaatactgcaatagtttggcaaagaaaatataaaatatttgctcaaacgaggtgaagagcatctttttcttccggattttaagatggatataatatacatttctgatgaaaatgacattaattgatacgtttctatacataggacagggcgttaattggggacataatctgccatctgtatactctccttatttattaggaggaaagttttttttaaatgtagtcattttcagtaaaataaaggtttgttcttataacatgaataacgctatttccttatctttacggcaaaatcatgtggggtgggattgctgccggcatgttcaaagcaaaacaaacaaaataaataagatctccagttagaagcatatgatgacttatattgttattggtatcctttttgccattatcctacttatctgtatcaaatattggtatttgtgtagcaagctgaatctgcaaaaaaacgaatggatggctcatataaaagaatcagatactattttacatagtatgaatgcttgttttatgttggtagatcgtgattttgtggtgttaagaaccaattattatgacttgaacggaattcctggagagcctgtttccaatagggtcggtgatttgttgaagtgtaaaaatgcggttcggagtgaagggtgcggagcgcatcataattgtggaagttgtatggttcgttataccattgaaaatgcgttttgccataaaaaaggttttagtaaattggaggcatccatgcggctgttcagtccagaccatcagcatattattccttgtgatgtatctgtttccggaacttatctgactgatggagatcaggaacaaatgttgctcacgatctatgatattactgagttgaaaaacactcaacggctactaagcattgaaaaagaaaatgctgtctccgccgaaaaactgaaatctgcttttattgctaatatgagtcatgagatccgcactccgttgaatgcgattatcggcttttccggtctgctggcttttacggatgatgacgcggaaaagaagatgtacctggacattgtggcagaaaacaaccatcgtttattgcagattgtgacagatgtacttgacctctctaaaatagagtcgggcagtctggattttcactattcccgatttgatgtgaacgatttgttgtgtggcttgcatggtatcctggagattcgtctgaaagataaacccgatataaaattggtttgtgaagcaggaacagatgaatggatgatttattccgaacagcagcgtatcgtacagatattaacaaatctggtgcataatgcgataaagtttacccagaatggggaaatccgtttcgggtgtcgtccccacggagagactgatgtttatttttatgtttccgataccggcataggtattcctgtgggggagcaagataaaatattcgataggtttactaaattggatcatgaagtgcccggaacgggattggggttgaccctttcacaaaccattgtacagagtctgggcggtgagataggggtagaatcggaggtcacaaaaggttccactttttggtttactcttcctttgacatcctgaatggtttctccaaagaaataagaggttgtatccggtagaatttagattaaatctccggatacaacctctttcattcaggtagatagatatttccttttaactttacttttgcggagtgtccttatcagaaggagcagaacctgctgacggtgcagaagtagtgctggtggaagtgttagcaccgcttacagccgggccggatactgttgcagtaacgggagctgcttgcggtttggcttgtgtttcccagtggaagggttcaaaagtactgttggggtcggcccatgatggtttctttgctgcgtagatgatgaacggagcaatcactacgatcagtgcgccgatgatcaatacagaaaaccatacagtgttgctgccggtagagatttggctgggcggaatgaagctgaggatgaatgccagcaatgagccaaggaagcccagaccgcctacaatccacattaaaccattacccttcttaccgatacggaacggacggttggccttcttcatgttatagcgcagatagatggcgccggagaacataagcaagtacatcaccagataaagaataactgtcaactgtgacaaaatctgatagaaactctgtacggaaggcataaccacaaacaaaaggctcaatacggtaacagcaccaccctgaacgaacagaatgtttttctgtacacccagtttgttagtcttctggaagaacggaggcatataaccggccttacctacggcaaagataccttttgacggaccggcaacccatgtcaatacacctgccaacacaccaaatgcaagggcgatggcgatgattggtgataaccaggaggcatggatatatctgaagtaattatcgaaacctacaagtaaactctgtgtcaggttaatgtcttttgccgggatgatgatacccagtgagaaagttcctaaaacgaagataataactgtgatcaaagcaccgatgaatacggccttaggatagttctttgaagggttttgcatgtctttcacatgaatgccgcccatctccattccggcataaaacaagaagatactggcagccagtacaacattatcaaagtttgtgagatccgggaaaaaactgctgtggaaatccaaattggaatgtcctcctgttgctaaataagcgatgccgagaataattaaaagagctgcaggaataatagttcctacaagtccgccaactttcgctactttaccaacccatcccatacccttgagagagatgaatgtggctaaccaatagatgattaaaacaacgattaaggtgtaaatcttattgctcgctaacgtcatatcgtgtgcgtcattcgttccgataaaagctatggaaacagcaccaaaggtgagcactgtaggataccagatggtactttcaatccattgtaaccagatggcaaggaatcctaatttttttccgtatgcttcgcctacccaacggaacacaccaccttgtttgtcttggaacatggcagccaattccgccgcaacgagtgatgtcggaataaggaatacgatagctgcgaaaagataatagaaggccgaactcattccatatacggcctcggcaggaagtccacgtagggatactactgccgttacgttcatgatcgccagggtgaatacccctagtttcactgcttgtttaatatttgccataagttaaggttttaagtgaaaaatatttttaagtcagtgtctataacaacgtttaacgtaagatgtttcagtttactaacgtcaaacttggttaattaacatcggccaagagtgagaaaaccggtttttctcctgatcttgattcgatatcaaacaaatcgtgtatgactcttgttccttttgcataattaaaaataacccataaaatatcagtgcttatgaaaatggctctttctgatttttctttacggaagaaagggatctacggcattctacatgtcatcatcctgctgctttctctttttctggtcatcagtatttcgattgatacattcaagggcatccctttttatactcagtcggtatatatgaaagtccagttgtggatttgtgtcttgttcctgttcgactttattctcgaattgtttctttcgaaaaacaaatggcactatctcagtacacacttcattttcctgctggtggcgataccctaccagaatattatatcgtatatgggatggactttctctcccgaagtgacttatatgattcgtttcgttcccttagtacggggggggtatgcgatggccattgtggtaggttggctcacttataataaggcttccggtctgtttgtctcttatttgactatgctgcttgccactgtctatttttccagtctggctttctttgtgcttgagcataaagtcaacccgctggtgaccggttacggagatgcgctctggtgggcatttatggatgtgactacggttggttccaacatcattgccgtcaccgtgacgggacgtgtactctcggtgctgctggctgcactgggtatgatgatgttcccgatttttactgtttatgtcaccagtctgattcagaagaagaataaagagaaagaagaatattacaagcagttggaggcggccgatgacagtaaacaaaagtaaggcttttcagctctctgtcccgcagggacgggagttgatatagagaaagggaaatagctctattcggagaatgcgtcattggagtgcgtaccctatgggagggcatctgtcacgtcgaatgccggttccgtttacataccggggtaaatgcttttacgtaccggggtaaatggctttacataccgaggtaaatgcttttacatgccggggtaaatggttttacatagaaagggaaaattcaggtaaatataatctgctggttatcagtgttactgaggcggtcgcccaagtcgatgttttccggataaaactaaaaatactgcccatccgcatatggcagacaggcagtattccaactaattaaactttgtatgatgtcatcaatttatatgcttgttcagctcgtgccatttattgatttccggaaggatacccatagctatcacttcatcacgcagtttgcataagtgagcgtagctctcttccatttctttctgctcttcaggagtaccttgtacttctttatagctaacgccttctttggtgatggaagtttccattgccatcaggatgtggtcgaacttcttgtcagatacataagtgcctgccggccagcggaaaggttgtccgcccatggctgccgcgatcatttcgatagacagataagccgggctttggaatgaagagcgtccgcgcagatcaatgatgtgttttccaccttgaataacgcgtactttcagatcttcccaatcctgcataggcatgcgtggagtatcgatgatcttggtcagcgcttcaccttgtactttagtggtagaagcaaatacggccatctgttctccgtggccgccatatgtacggcagtttacaatttcggatgcggggatatggaggtacttcaccagttcgttttgcaggcgggtgctgtccagagcggccagtgtggatacctgtgacggtttcaagccggcatagagcaatacaatcagtccggtgatatcggcaggattgaatacgacaaccacatgtttcacatccgggcaatactggcggatatctttaccaaactgggctgcgatttctgcgttacctttcaacaagtcttcacgggtcatgcctgctttacgggcggcaccaccggatgacacaatgtacttcgcacctgataaagcttctttgatatctgaagtgtaagtcaggtttacgccttcgaacgcacagtggtacagctcctcggctacaccttccaaagcgggtgcataaggatcatacagacaaatgttcggagtcagtttcatcatcagggcagtctgtgccatgttagagccaatcattccggcagctcctacgatcgtaagtttttcgttggttaagaattccataatttatatctttttttaattcgacaattgctttgtttcttgtttccggtgcaaagataactcgtttaaacgcaggttgtttatcgaaaaaagttttgcgctataatgaaaagttatcgtctgcggatgataacaaacagatgcagcgatatgtttttcgacggcttattattcttacgtctgttttttatttatctttgtcacaaactgaatgaagattatgagtattgaattaggaaaattcaaccagcttgaggtagtcaagcaggtagatttcggtatgtatctggatggcggagaagaaggcgaaattctgctgcctacccgttatgtgcccgaagattgtaaggtgggagactggttgaacgtcttcctctatctggataatgaagaacggttgatagccactacgctgacacctttggtacaagtaggcgagtttgcttgtctggaggtatcttgggtcaatcagttcggagctttcctcaattggggactgatgaaggacctgtttgtccctttcagtgagcagaagatgaagatgcaggtagggaataaatacgtcattcatgcctacattgacgatgaaagtttccgcatcgtagcttcagccaaggtagaccgctatttgtccaaagagaaagctccttatcagccgggcgaagaggtgaacatacttatctggcagaagacggaccttgggtttaaggcgatcattgagaatatgtacagtggtttgctgtatgatagtgagatctttcagaccttacatacgggcgatacgctgaaagcatatattaagcaggtacgcgaagacggcaagatagacctgattctccagaaaccgggttttgagaaagttgatgatttctcaaaaacactttaccgctatattgcagaccacggcggacggatcggattgaatgacaagagccccgccgaagagatttacgatgttttcggtgtcagtaagaagacattcaagaaagccgttggcgacttatataagaaacgtctgatcctgctccacgaagacggaatcgagttggttcgtccctaaactgaatagggaaaaccctacgtatgaatagacagaatcattagggtggggagtttcctcaccctatttttgtgatattaaaaacaataaaaactaaacgatatgcgaaaagtaatcataaccctttgtttcttgttcgctgcatttatggcacaagccggaagaatcagcggaataaatatccagagtgcaggtgaggcgattcttgtctttatggatggcgaacagatatgcacgccgacagagacttgcttcatagccaactattcgggcagacaccgcatagaggtatatgccgcgcgctatatcccgcgcaccggacagagtgtaaaaggagatttgttgtttcaggaatgggtgtcaaatcccggtatgaacatacgggatatccgggtaggtagagaggggcgtcccggatacggatatgatgtggtgatgaaccgtgcagagttcgaccgctttctgagaacagtgaaagataagcctttcgattctgaccgcaataaactgatcgagactacgcttgtctctaccggctttacttccgatcaatgcctccagttggttaagttgttcagtttcgacagtgaaaaaataaagctgatgcaggccatgtatccgcggattgttgataaaccgaatttttatctggttattgagagtctgacctttcagtccgataagaataagatgaacgaatttgtgagaaaataccatagtcaacgtaactaaaacctatatacattatgaaaaagatacatgtttcagcaatactactcttgctcgttgtcatgagtagttgtgccagcctgttggcagatttcaggaacagccaactgatgggtattcagaaaggaatgacgcaacaagaggtgaaaaccattcttggagaaccgaactacagacgctttgatggaggcatggaagagtgggaatatcgcgggtacctttccaaagcagggccttcggtgatttgcgttaactttatagacaaccgtgtcgtagggctggattcgttcaaggacggtgcacccactgttcctcccgctccatctttctctttaggtattggcggtacggtttccgcttcggaagtggggccttcctatagctacagggcaatgagaaatgatgaatttgcccgcttcctgaatgatgcaaagagtaaaacattcgactcggacaggacggactttatcgaaaaagcagcgagttctaccgggtttacttcagagcaatgccgtagactgataaaactttatagctttgatgatgaccggactaaggtgctgaagatactttacccgagtgtagtggataaagataacttctccatagcagtagatgaactggacttcctgtcgaatcggagtactgtgaaggactttgtgaagaattataatagaactaaatagatttgagatatgaagaaacgagtactgatattctttctggccatcggaatcactgctgtaagtagtgtgagcatggctgccatgagcaatagccgcattcgtaaggagactcgtttccttaccgacaagatggcctatgaattgaacctgagtacgggacaatataatgatgtatatgaaatcaattatgattttgtttactccatccgttatctgatggacgatgtgatgcggggagaagagtgggcgctcgataaatactatcgcacgttggatattcgtaacgatgacttacgatgggtgctgactgcttcacagtatcggcgttttataggggtggattatttctatcgcccgatttacgccaatggcggaggctggagcttccgggtctatatccggtatacaaaccataaccacttctatttcggaaagccttaccactatagcagttattgcggcggacactatcgtacgcactatcataacagctattatcgcggacgttaccggcatgatttctattccggttcccacagcataagagatcaccggaattataacacgcaccgtcgttccgatttcggtacggtaactatacgtcctaattcggcacggagagatgatgtgcggaggaatgatgtgcggagggaaagttctgcctcacgagataaaaacagggtgactccgaggagttcggcaactcctaatagggtgactcctgaacgtacggatagcagacgcagtagtagccggagccaggagagggtgaagagtaataatggcacccgaagttcagtctctgagcgttcttcttcaagcagacgcagcagtggaaattctgcttcaggcagtagccgtagttcttcttcccgctcgtcggaaagagggagccgggataaataacgtcagttcgacgaattttatttgtctgcatttcgatcttccatcttccacctttttgagtttatcaatctaataatcaaagagatacccgggtggaagatcgcatttttcagccctttatcttccacccgtatcttccatcttccacctactgttttaaggcaaaaataaggcgtaaaatgctggtcatcagcctaaagatacgccttgcttaagcaaatacacctcttaaagcatttcgttttcccttgttgtttaaccggaaatggtgcaatctgcatccggtttcgggcaggcgtgcccatgagcccgggtacacgtgcccatgagtccgtatacctgggcttataagcccgggtatacgggacgagataaagataccgacatgaatgattaaatattgataattagatcattaaatatgaaatagaatagagaaacgattcatgtgaactggttaaatgaaagaaaaagaaccgctgtcctccggggggtagagtggcagcggttcgacgagttaactggtttggtgagtcggatttagatttaaagtcaattataaaagagaatttattatgaaagatcaaagtactatagcccgtctataatgacaggcgttttgtgataatggttctttttgcatatttgattgatccgggatatatatttggaagtggcatacgcctggcttggtgtacgtttcaggcacgaatatttcactttatgaatttctaaaagaagttcggctacaaagacaatcatgtctgcacgttctatatgggaaggtgaacagaaacactctgcatattcgtaatcccgggtagagagtgtataatgcagaatctttttacctcgctgaaaaataaaatccaaccgataccaaccgtttgcgttggttctgcgccggtggaaagacaagattttgatagtagattgtttgcccatagctcaaacgtatatcgggcagggaaaaatgaacggccctgctgacccgctgaactatatcaatttcgatgcgaaacaaagaaataacatatgctaacccattacggaattagacacgggggcagagccgtctttatcctgaagctacggacatatacatgtaatacgcccgtagccagtttaaaacaaagagatgtatctcttagtttcgccaacaaaaaattgataatagttcaccacaaagatggtgataatttttggattaccatagcaaacggctaaaaaatgtacaatgaaacactttttgcggtggaattgtttgctgaataccctttgtatagggggacttaacaaagaaataacggttctgtgtcggtaaatgctctcttagcagataaatcagttaggatggggatgtgtcaaaagccttttcacacatagattatcacagattaacaactttactaatcaatgacttaaaattcactctgtgtcctctgtgtcctctgtgtcctctgtggtgagtttccctctattctgctttgggtatctgataaattactgtatgctgtctctcctcaagtctttccttgcttcgccagtcacatttatctccggtcggatactgtcggccgctgcttcgctgataactcccttttttgccagtcgttcggctatcaatcgataatagccttccaggttttctttcagtttcatgtcaccggtgaacgaatttcggaaatgcttgggcttcggaatgatggatgccaggaagatggactcctcggctgtcagttgagacgggcgttttttaaagtagtaggcagcagcctcctgtgctccgtagacaagcggcccccattccactatgttcagatatacttcgtacatcctgtctttggaagtgagacgttccgtttctatcagccagacgatcagggcttcttccagttttcgggcgatgtttttgttccggttcaggaatacgttttttaccagttgcatggtgatggtacttcccccacgggcaaaacgtttcactttcaggtcttgtatcaatgcttcacgcatggcatcgggaagaaagccccggtgatagtagaaggctccgtcttcactttgcatcacagacatttgcaatagtggggagatgctgtccagtggcgtgaaatgttcccaagaggggcctatggggaaagtgcgtaccggctgtccgttttcgtaagccgtatagataaactcttccgacattttaccaaggtctgtggctccatatttcacgatgcggaagtttctctcctttaattccgattccagcttcaggctgtccggtagggcaaagtccacatccagcaagaaatgataggacagttcgccttccgtctttatcccttccagattgctgaataatcctttggggagcgagccgaagagttcgtttgccggaaaccaggacttgtttaaagctactgtgaagtgccattggtgttctctcttctcagctttcagataaggatgaagctgcatctggttgaattgcaccaaggttgtgctgtccagttcggcgaactctttacccacaagaacccggtaggatatttgtccgcggtccagattgactgtttgaggggaaagagctttgtgatacacttcaagtccgttgactgctgcttgtcctgtcagtataatctgaccgctgtttccttccgattcagtcaggctataggtaagggtatccaagcgaatgtccgcaccgaaacggcgtttgagataggggagggcgattttttccttatgctgtgcataaagttcggcttttagcgtgtggttgcttcggtttacctctccacaggtggtccagtgttggcttaccgaatcttcctgtacttcgatatcggagttgaaatggttttgccgtatgcttaattgcgggatgcggatggctacgaagttacggtctttccgttcgctgacgtcgacttgacgcagtgttccgttttcgggtaagagaccatagagcaggttcagtatcctgttcactctgtgggcatagtcggcttgtgccgaaccggccggtacctcctgttcctttttcaggaagaggaagtcataatttgctgtgctgtctgctttgatgaatgaaactttcagccggtcggcggttacgttgcgtacttcgatctttccgcgtagcagtttccagaagctgaggcgcatgttcagggcatgcagggtgaggagggtgtcccgcttgtcagggactacggaaagattgctcagctcgatttcgttcagccctttcattcgcaaggcatcgtagcggatggataatccgtatttttgttcggtgcgcagtatccgcttgccaaccattcggcagagaattccgttgcgtccccaatataaacctgtcagaacaaggatcaggacacttcctgtaatgatgagagcgatgctccctttcgtacgatattttcccattatgatatgtaaactacggatttatcgactgcaaagttatacaattccgggaggatggatgatgctctttccggaaaaatattctatctttgagaaatcgatcatatgagataccgtgaaacaactacgaacagatagacagactctcaatgacttaggagtgatggagagtacgtacggagagaaaactcttttctctctctttgacatgacggaaagtgacggaggaaagaggtgcttggaagattgggtaacccatcccatatccgattggcagatgctgcatgaaaggcaggaggcaatccggtgtccggacttccccgaaatacgtatttgcagggaagagttggattttatagagttttatcttagtcagggagaccgtccgacaagggttacttatctggaatctgttttatcacgtgctttcaggttgttcagaagtactcccgaacgctatatcattcagagaggaacaaagttgcttgaaaatgttttgctggaactgaagatttttgcggatcatgtgaccgaactttctccccggttaatccgcagcatggtagctactgtcctggagacttatcaggctacggagttgggcaaaatggtagaatcctgcggacaggaggacggtttttaccggaccgaccggctggattatattttccgctatcggcgcaaccataccattgctgatcttctttcgattgtatatcaattggatgccatccgtaccatgcaccgcacggctgttacgaaaggatggtgttttcctacgtttacgaccgatggcaaatttgtgcttcgtgacttttaccatcctcaggtgaaagatgcggtgaagaacgactgggatatggagaatgggaatatctgtatctttacaggatcaaatatggccggtaaatccacgaccttgaaagcgatagcgtccgccgtatggctggctcatgccggatttccggtgcccgcttcttctatggtctgtccggtgtttgatggtatctttacttctatcaatcttccggattcgttaagggatgggcgcagtcatttttatgcggaagtactccgggtgaaagaggtattgcaacagattaatgaaggtaaccattgttttgtgctgttcgacgaattgtttagggggaccaatgcacgggatgcttttgaagcatcggtagccgtgaccgaagtgctcaggaggaaaattcacagccgtttcctgatatccacgcatatcatagaactggcccggaggctggatggagacgattcttgttgcttttattatctggagtctgccataatggatgacgaactgatatgtaatcataaagtgaagccgggtatttcggagtccagggtcggatactggattgtgaagagagaacttgccggcttctgaagataatgtaagtagttactgtaggagaaattgtgaataatacatatatttgtagactctattaatctaaaaaacaaggacaagtatgaaaattaaattattattattgattagtgttctgttctgtacaagtagttatgcacaagagacggttactgaacctgattttataggtgaggtgttagccttgaatgctgacaacagtacgactccgttggaaaaggctaccgttaagatcaaaacaaaagccaatgcctcggtatatttggtgggcatgggcaaagtgaagacaaaaataaatgtagatggtcccagcgcccgggtacgattgcatcggggagatgattttaagttgattgtgagggctgtggacaacaataccgatccgatgtctattatcaatatctttcagtttgaaataggtaagaaagtacgtaaggccgaactatcttctttgagtacctttggaggggcttctaacaataatttggaattacttccgtataccgctaaaaagtatggagaaagttcttatctgattacattgaaagaaaaaccggtaggtgaatatgggataacggttcgtaatcctaattctttggatgaaaagaatatcattgtagcttcatttgcaatcgatgaataataagcgtttatagccggattactattacttgaaataacggggatgtgtcaaaaaccactgtggtggaaaagcttttgacacatccctgttgttagcttttgctgttccggttcgattccggcactattataatcggctgacagacttttgcgacatcctgattattattgtatcttgattacaaccggtttacggatgtccgtaaccttgacttgcactacaattccgtttaattccttatccggagtgactcttacctttttaccgttcacctgtatgctggcttgtgtcgtgactcccggcagttcaatccggtaagcgcgtttccggggctgcccttcataggttccttctgccggcgacacggtgatgattgtttgttctccggtcttctgatagttgaggcgggtggtggcatacttgccggccagataatcctgcgtcagtccgtcatcctcgtacagggtgtaagtgttgtccgctccctcttctcccggatagcaacgtacggtcagttcggtgagcagggtggagcacattctttccgtatatggctgcatcggcagcggatggcctcctttgataaacaaagggaattcgtccagtgggctttctgtctttatgacttgtccaccctcttgtttctcgccggtgaagaagttataccagcttgttccgccaggcagccagacctcttgtgtggctgttttcttctctcctttgccctttgtagtgatgggggcacccagtaagagatctccgaacaggaattgccccggatattgataggctttttcttcttccggatattcgatgtacatgccccggttgagcggcaacatatccgtatggcactggcggacggaggagtaaatgtagggcatcagctgcgagcgcaggtgataaatcctgtgcatggccttttctgcctctgtcccccaaagccaggggcggcggtcgagttttttgtcatataccgagtggatgcggagtgaagagttcagcagtccgaattgtgtccagcgggtatagagttccggatcggttccgtcatagaatccaccgagatcgtgtgcccagaagaaacagcccgcattgccgctggtagtcgtcaggtcaacctcaaagcggagcaagtcccagttgcccacggcatctccggagaactggatcggatggcgatggtctccccaacctgcccaacggctgaatcctgcgccgcggaggcggttaccggccgagtagttataataaatgtggttcagccagggaaggtgtttcatgtttgtaccccgtaccagcggatacagataatcttgttgccagtcgagccaccagaatgctacacccatggagtcgctttcctgatgggcatgtttcatgaaggcattcatataattgcggtcgcctgcgtcaaacaagggtacgccggttttcagcgtatctgctcccaggtcacgtatgaatgctttgtagctgtcctcgtgcgggcggataccgtcgtgcggatgttcgttcagtaccacgtaaatatggtcatctttgaagtcgcttatcagcttctccggttccggaatcagtttccggttccagctgtaacccgtccagccgcgtgtgccggcatgtccggttcccactttggcgttttgcgtatgccatcccatgtcgaacaccatgatgtcgagtgggaagtcgtgttcgcgatattcacgtaccagttgacggtagtcttcgtccgtataattccaccagcggcaataccaggaaccgtatacatatttgcgggtcatcggtgacggaccgctgactgcctgaagcgattttagggctgccttgtagtcattgccgtaaacaaacagatacaaatcctgtacatggctgcggtcgcgttcggtgacccatccgtttttcaggatttctttgccggtgtcgttaatcaggtaccatccatcgcggctcaataatccttcctgtcggtcgatggggccgtctacatcgtcgagcgtggtcaccggtcccagcaggttccggctttggcggctggctatgtaccaacgcgtctctttgggtgcgtctccgtttctgaagtagacaaacaggttggtttgcccgaaggggaatccgtcgttgtagtactcgatgcgcaggacgggggtggtcattacgtagcggttgccctcttttctctccacttttacgtcggtacatctgggagtgcggtcgacagcgaagagtgtagagtcattcaggaactgtccctgctgtgcgtactccatacgcaccagatggtcggtgatgaacgtgaaccggctgttgcctataactaccggatttgaacagaaggacggcaggcagaagagtagcccggctatccggagaatggttcgttggatgtttctcatgtcgtttttattttcgttaattgaactgttcaggctgtatctgtattttcatttcatacgaggaaccctcgcatacccggacgagggtgcttcgtatactcggacgaaggtgcttcgcatactcggacgagggtccttcataagattctccttttatggattctgttccagtactcccggatacgagtcgatctcacgttgcgggatgaactcgattgctgccggatcatcggcagaaatggtcaggcgaaccgaagttgcggcgccacggtcgtgagtacccggataactgcggttcatcgtcagtccgttgcggaagatgtcgaaacggcgatgaccttcgaaggccagctctttgcgacgttcttccaacacgtattccagcagggttttgcccggtttcatctcttttgccgtgagtgccgggatgtgtgcacgggtacggatcacgttcaggtctgccaaagcatcgcccagtgccggttcttttgcatacgcttccgcacggttcaggtacatctcgcccaggcggagaacggttggcgaccacagttgaggctggttctcctgcttggagcatttgtatacatagtacttcgggtagtcgttgcgttttgccatcaggttctggatggttacgtaatgcttttcgtacgtgcccggattggggttatccttgccctgtttcagtctagattccacgtaatagcctccggcatcctgcttcatggccagtgtgtctttgtattcgtacttcgacagataagcgtccttgatgcgatagtttccgttttcttccacgatttcattccagcggtagtactttctgggcactccgtcttcttcggaagattcgatgtagataaactctttgcgatattcgcccgtatcatcgtctttcagatattgtggaacgatgtagcgtgagcgcagatcttccggatattcggcatacgcatcccggagtggttcggaagcgtacaactctccccaacccacaccgtcgatgttggcataaaagcctccgatggagttccagccgtagtcgtctttatctttggtgcaacggatggcgaagatgatttccggattgtcctcgggcaccagtacattggctgtggcatacgtttctccttccaatagtgtgcgtcccgagctttctatcacctccgttgcatattcggcagccagtttattgttacccatatacaggtagacacgtgacagtagcgctttggcggcactggggccggcgtagatattcgattccgagttcaacagggcttccgctttcttcaggtctttcaggatctgttcgtaagattccttcacggtagagcgcatcggatagtcgtttacgtccgccgtcagtttcaggggaatccccaggttggtttccggcgattggttgtaagggcgtccgaagacgttgaccagtacaaattgcagccatcctctgaggaagtagttttcaccgatcagctgatccatctctttgctttccccctcttgtgccttctcaagtatcttgttcgagttgatgatggagcggtaggcccatccccacatgttggacatgtggtagttgtccgtgatgcgctgatagttgtagatgtacattaaggcatccgacgatacaccgctcaatgacacgttgtcactggccagttcgcctgcatagtgccatccctggtggaaagcggtttttttgaatacggcatagttgccgcgggtggcagataacaacgattcatagctgccgtccagttcgtcttccgtcagctggttataggggagttcctctatggagcaggccgagaacccgatcagagaaacgaataagcaagatacgatatgtttgattttcataatatgacgtgattttttagaatgaaacattaagaccgaacacgattcttctgctcaacggatagatggtacctgcatagccgtccgtgctgctgtccgacagttgcggagatacacccgagaacggagtaaacgtgaacaggttgtcggcactgcaagagacgttgacccgttgcaatcccagttttccgcatagcttttccggtatggaatatcccagtgacaggttgcgcaggctgaagtagttgcctttctccagatagcgtgaagacgatttgttggagttcttgttaccgccgttgatggctttcggatgcgtggcgatgtctccttccttttcccagcgtttccatccgcttttcaacttcatagagttgtagtcggcataggcaccgtcggagtcaagcaattcacgggattggttgtagagcaggttgccatatacaaagtcgaagttggcagtcagcgtaaagcctttgtaagtgaacgagttcatccatccgccggtgaacttcggtgcggcagaaccacagtatacgcggtcggctttattataagagtcggtggtgacacggttgccgttttcgtcggtggtataccacagcggagaaccgttggcaggatctacgccggcccattctctcaggtaccattcgtccatatcccgtccctcttccagacgtttcagacccttcagttccggtttacctccataaagttcggttacccggttccggttgaatccgatgttgaaatcgctggtccattggaatttggacgtacggatgacatctgcgttgaggctgatctcgatacccttgttattgatggcacctacatttttgtattgtcccgtataacccgatatattgggcagcggggcgtagtacaataagtccgaggtgtttttgttgtacaggtcgatggtaaccccgaaacggtcgaagaaccgtgcgtcaataccgatgttggtagtgtaacacttttcccatgacaggtcggcatttcccatttgtgaggggaaataggcaacttcatcattgtacatcattgaagaatagagcggataatgaccatagtatgctccgggagtgtttcccaaagaaccgtaactcactctcactttcagttggtcgatggattcacggagagactcgaagaaaacctcgttctggatattccagccaccactgactgtgaagaagtgccccatgcggttgtttttaccgaaacaagacgattcgtccatacgataagacacttgtcccatgtagcggttgtcataatcatagttagcgttgaacaaggccgattgagtggcgatggcatctttgtatccaccgatggatttgattccggtcgttacatccagaatctctctgcccggctggatgcctcttccttcggcagaagtcgattcataaaagtggcgggtgtattcgtaagctcctaatgcgtttaccttgtgtttgccgaatgacttttcaaaacgtatcatctggttggtgaactgcttggtcagtaacgaattggagtttgacagagagcctttgtccgattgtcccgaacgcgaacgcttgtccgtatagctttcggagcggttactgatgtaacggatgtagttgttcgattcgaagcgcagccaatccgtaatctggtaattgaaattgatggtcccgtcaaccgtcagcttctttgaacggccccagttccattgcaggtcatacatgtcgttgatcccgtcacgccctctccagtcctgctcttgtcccgagcggatggagccgtcttcattgtacggataatcccagggcagatagaggtaggtgttgtacacactgcgctgttggctgtctgtgcgtgacaacgaacccgaaatcttggttgacatcgtgaagcggtctgtaaacttcacatcgttgttggagcggaaagtgaagcggtccagtgtaaagtccttgatggcaccctcttcgcgataatagtctgccatgacgaacgaacgcatgcggccgctgcttccggtataggtaatgtttgcgttggtatataatcccggtttggaagcttctttaaaccagtccgtgttgtgtttcagcagttcttccgtgaaccatgactgattgttccaggacttctggtagtcgtaaagctcctgtgaattcatcatttcaagacgtccggtcgagagcagcgatacaccggcattcaccgaaatgctatatttgttggcatcgtattcacctcttttagtcgtaactacaatgaccccgttggcggcacgcgaaccgtataatgccgtagccgagccgtctttcaatacgctgatgttgtctatttcattcgggttcagtctcggatcttcacctacgatcacaccgtcgactacccaaagcggggagactgacgagttcagcgtgcctttaccgcggatgcggattttgctggcctgtcccggctcgccggatgaaccggagacgtatacacccgaaacctttccttgaagcatgtttcccacttccagtgtgtttacgtccttcagtttatcggctttcacaacagccactgagccggttacggccgattttgtttgcacggtatagcccaccacgacaacctcttccagcgtcttactgtcttccagtaacttgatgttcaatgtcttctgagagcctactttaaccgtttgagtcagataaccgatgaaggaaaccaccagttcgtcaccaactgccgcttcgatggagaattcaccgtcaatgttggtactcacgcctgtagcggtaccttttatcataatattggcaccgatgatggtttctcctttgatgtctttcaccactcctgtgatgatacgcttttgcagggaagcgtctgtctggtttgtttttgccatcaacatgatgttatggccctccatggcatagcctacattggtgttacggaatagagaagagagcacctcggctacccgttgctgttttacgtttacggttgtgtgctgattgacatcgacttctttctcggagtatacgaacagatagtcggtctggcgttctatttcgctcaggacttcccggattggtttgttgtttttcgagatagatacctttgtttcctgagagttcgcattgttggcgaatactcctgaaatgaaaacgaaaaggaataaaactatcattttcatagtatgtgaaattgatttatttacgattttacttgtttttatcagagtgtttttcatacatttgtacactgtgttaattaatactcactaagttttcgcagactggggtattgttaacccggagccggaagtgtgccaccactttcggctctttttgttcttatgttttcatttgttccggtttttaatttaaagttaatacttggtttttagtttatagtaatggtattatgttcttcgtcgcgtttataggtgaatttacatttcaattgaagtactttcagcacatgttccacaccatctctgatacggaactttccggtaaaccgtacattcgccagtgactctttttccaagacgaattttacatcgtaatataggcctaactggcggatgatttcatccatacgtgtgttgtcgaaatagaggattccttgcatccacaatgcccggttccattcgctgatactctctttccggagctgaccggctttgccgaacagacgttcgttgggttgcagtcttactttcttaccggtagtggtctcgctcacctcaaccgaaccttttaggagcaccgtttcaaagaaatcctggtctttatacatcatcacattaaattccgtacccagtacccttacttcatattctttggcttgcacgataaagggctttttttcgtttcttgctacctgaaagtacccttcaccatccaatgtcaccctgcgctctttccggtcaaaccggtcggggaatgtgagtgtcgaatttgaattcaggcatactcgtgttccatcgcccagtgtcagttctgcccgttgtcccgaaggaacatgtatggctctcagatccggggtctgtttccctctttccggcgccaggaaataaacagaggtaactgctatgaggaagatagcggcaattttaatgatctcccggatgaaggggagtgtaaaccgtttctttccctctatgactgttgccggtttttcttgccagagagtgatgtcgtacaactttctcaaggccagatattcgcgcatgtgttgtgggtcggcatccaaccattgcgctaccatctgtttttcttccgtactggcatctcctgcaagatatctgttgagtatctcttgattcataatttattaagagttcttgatgaacgtttttcgatccgttacatatataagacgatagaaatgaatgtaaccctaatcagtttcttcattttttttagtgaaaatagaaaaagaagtaaaaaagaggtagataatctttgagtgaaactcgaaattctttgagtgctttcgatatgtgatattccactcctttaactgtaatgtgcagttcttcagctatttccttattcatcttgttctcgaaacggcttttctcaaatactaggcgggtctgttccggaagtgagcgtaaagtagcctgaataattttgttaacttcggcagaaaaaatctccgatgggtcgcaagcttccagactggatacacgaatgtccagttcacggacacaaagttcgctcaattcggacatcgcgttcagtttgttctgttccagacgcaggtaatccagtgatttgttcttcaggatagtgagcaacatagcctggggagaatttataatatcagatttcagcttctcccatagctttatcagggcttcggcagcgatgtcttctgctgcctgttcgtcgtgtacatacgatctggcaaacaagaaagactttctgtagtagagagtatagagagtattaaaactgttgatatttaagtcgtccatcctaatattccgtacctgggtatttttctgtattatctaaatgcgctgcaaggtatgaaaaaaaaagcaaaagaggattaaaaggtgtgtgttttccttttttctgatataaaatgtccgctaatggaagtgatatgtccgttgctgaacatctctttgttttatatatatgctgataattagatagttgtatacttggcacattacttgtacagggataaacgggtgagttgtccggtcgtggtgtaacttactcttagattgtaattttgattgataaagggtggaatgtgaatttcgccctttattttgtgcgggcaacagggtaaaaaagatagggggtgtgtcattattcaccacagagtaacacagagttccatagagagaacttaatctgttgatagctaaggatatttatctgtgaaaacctgtgtagtctgtggtgaataatgacacatccccctatcacttacaataataataacctcttttcttaatcaatgggctgtcctttatagaagtccagtatctttgtacggaacagataatcatatttggcttgaatctggtcggacaatgctttggtgagattcagcttagattcattgtattcaaccgaagttgcttttccattatcgaatttctcactcatcagacggaaagattcccggttggcctctacggctgattcgcttgacttaaacttgctttcggcggctacagcattgtaccatgcttgttggatttctttgtacagtgctttcttgctgttgtccaattgcagtgccagattggtctgttgcaggcgtgccgtacgtacgcggttgcgggtagccagacgattgaatataggtatattcaaactgaatccggcatatttattcaggttgttcttcatttgattaccaaaacttgaaccggcactaccgtttactgtatagaaattcgtacctaatccggctgaaaaggataactgaggatagtagctgcttttagctatacggatgtttttctcactaccttcaaggcggtattgggctgctttgataccgggcttgtataacatggcctgattataaatatcgtccggtgaagtaagtggagaaaactccaactcagtatccggggcagccaatgcgaagttctccggagttggcagttcaagcaattggcttaggtcgagcaaagccaaccggtaattgttatctgcctgcacagcgctcatttcgtcttgtgcaacacgtgctttggcttcagcaacctcggcaggagaggcttttcctacttcatgcaagcgggtgatacggttcagttgctctttactgaggcctacctggctctgggccactttacttagttccagattaaagagtacttgcagataagcagaagtgacattgatggctagatcctctttcgctttattcaagtcttctattgcagctttcaggttgagcttcgtaagctcgtactgattgggtagttccagaccggtgaataagggaatgttcgtacccaggctaaagctgctgctaccgctgttaatgtcgttgtaggtattgtctacgggtgatgccgtgcgcccccagctccagttttgcgaagcgctaccgctgaggttgggcaggcgtgcccatttggctgtgtttacatccaccttgctttgttcggctgaatttgctgtttgctgcacactgatgttatgctcaatggcataatcgatacactgacgtagagtccatccttcctgtgcctgtgcagcgtaagtggacagtccggtcagtatcagtaaattaattaatattttgtttcccatattatgcgttgttggtgattcgtattttctttatacctcttttatatataaaggcttatttacttttcttttccgaagctctcactttttcttttccggtcagaccttctttgatttccagtttgataccatcgctcataccggttttgatttggcgacgttcgaacttctgttcaggaatgctatcggtcattacccatacgaacgtgctgtcaccgctgaattcgattacaccctcgggaactgccaaaactttctgtgcgcgttgcagcacgatttctgcgttggcagaatatccggaacggatctgtactgaatccggtgcgtgaacggccgctttaatctcaaactgattggctccgttttcttccacacctttcggagaaatgtattctagttcggcatcaaatgtaagattctgcaaagcaccgatcgtcagtttcaccggcataccttcatggatacgtccaacctctgtttcgtcgattttacctttgaaaatcaggtcattcatgttagctaccgtggcgatagtcgtaccgtcattgaacgtattactcataataacggagttacctactttgataggtacatccagaatcagtccgtcgatggtcgaacggatcagtgtgctactgaacgatgcactgtttttggtgataccctctttgatgatttccaatgcatcttttgcagtctgcaattcttcgcgtgccttctttatatccacttcactcttctcgaattcctctttgctgattagcttgtcattataaagcttcttgatacgtccgaagtcggtctctgcctgagctgcactgatttctgctacgcgcacacggctttcggctgagtttaactggcccagttccggaataactttcacttttgcgatcacttcaccttgtctgatggtttgtccggcctccttatatacctcggatatgataccggatatttgtggtttaataagtacttcatctcgtggttctactttaccggtggccactgtagtcttttccaggtcggcaacttccggggtgacagtttcatatacagttgtttggggtttcgacttctggtacaggaatatgaatgtcccaatgaagatggcggctaccactaccagtaatgtgattttcagatactttttcatcttgttttatattttgaattgttattttctatacttgactgtgtctcttttctgctttttgtgggggagaggctgtactttattcatctctgatagcctctatcggacggatggccattgctctgtaagccggtgccagcccggccagtaatcccagtgtcacgagtaacaggcaggttccgatagccatgccaaaggagacctggaagtgagaataatggtctttaccggagttaacgcctatttccatcaattgcaggatcaatactccaaaagagatgccggccatgcctgctatggtagtcagtaccatactttccgataagatctgttgcagaatatctttcggacgggcaccgatggcacgtcgtatacctatttccgtggttcgttcctttaccgttaccatcatgatgttcgatacaccgatggcgccggccagcaaagtacccaggcccaccatccagatcagtacatggataccggtaaacaaattatccatcatcgagaacatggcttccgcattcagtttcatgactgcctgcttatcgtccggtgctatatagtgtgcttcttttaggatgctttctatttccggttccagatcgcttacttttttcccgggtttcacggtatagcatatcacatcgatacgttttcccatattgtaggcttgttgcatggtactaaaaggtaatacaacagcttccgaagctcgtccctgaatatttatgtttccttcggatacgcacataccgatcacctggtaatagattccgtctacccgtacatactttccacaaggatcttcgcccggattgaaaaggctttcgtaaacgcgtttgccaatcacgcagactttgcgtccttcgcgtacgtccacatcattgatgaatcttccgtaagccatatcctgattttcaatcttggcgtagtccggatagagcccctttacgctgcaatcatactttttttctccgaaaatggccgtcgagccccagcgggctatcgatggggtaataacatcgatatcttttactttctcacggatttgttctacatccgagttctcgatatcccagtaacgtcctttacggaatcctttgtaagcttcccctgttttctgggagcccatgaatcccgagttggtggcaaatccttcgaattcggcttgcatcatgtcctgcatcccttgtccgccccccatcagggctatcaacatgaagataccccagaatactccgaaagccgtcagcaggcttcgtgttttgtttcttgttatcgtgacgaggatttcctcacacgtgtctatatctactctcataatcaatctgctctaagtgcttcaataggtctgatacttactgcttttttggccgggaagaatcctgccaatgtgcctgcgattaccagggttaatgtggcctgtatggcaatactgatatctaccgtcggattcaggaataccgtttccgagaacattcccacatctacggtttgttctccggccaccttattcatccattcggtagctgcgattcccgctaccatgccgatatatccaaagagggtcgtaatggttacactctctacgataatcagccataggatggagaatggcttggcacccaatgccttgcggatcccaaattcgcgtgttctctctttcactgtgatcagcatgatatttgatacacccacaatgccactcagcagtgtaaagacaccgatcacccagatggccgtgcgcaggatacccatggcattctgagattgcagatagttggtaaagcggttccatatccatagtgcactgttgtccgaaggatcgaaacgatgtttggcacccatcactttacgataggctgcttcaaatgcctcattcgattccatcgtggtgagccctttggtcgtgaaagtcaggttgtttagtttatcgcctttattgtaaatcacctgtagggttgagaagggaatatatgcttcactgcttccctggtcacccggatcggtgtaaagtcctactacctgataagaaactccaccagcatttacgaattttccgataggctctgttcggctttttccgaaaaggatctcagccgtcttggtatgtagtacaattacttttcgccgttctttgaggtcgatatcattaatgaaccgtccctctgtcgattttacggattccacttctgtaaagttcggatataccccttccaatgaaaggttaacgtactcctgtccgtaactcagattcacattgctctgccattgactggcacctacgctgatgatgttgtcactgaaatgttccatggtagcattcaaatctttgttatccagttgaatgcggcgtccctctttcagtccgtcgtagggttttccggtccatcccggatagatcttgatggagttcagtgctcgtgcggaggatgacttttcaaaagcatggattagcccgttaccggctcccaatagcactatcagcatgaaaattccccatgctacggcaaatccggtcaggaacgtacgaagtttgttccgtttgatggtgccatatatttcttgccaaatgtcaatcatatttgtatttgtttttatttcatatatccatccttgccgaatggtgaggcatcatgattctggttctcttcaatccgttcgataataccgtctttgatgtgaataatcttgtccgtctggttggcaactccgctttcgtgggttactacgacaatggtcattccggtcttgtgcaggtcttttaggatttgcatgacttctactgaagttttgctgtccagtgcaccggtaggttcgtcggccagaataatctgaggctgtgtaatcagggcacgggcgatggctacacgctgtttctgaccgccgctcatttcgttgggcatgtgatgtgcccagtctttgaggccaagtttgtcgaggtattccatagccattgcgttccgctttttccggcttactccttggtaaaatagaggtagtgcaacgttttctactgcgtttttgaatgaaatcaggttaaacgactggaagatgaaaccgatcatccggttgcggtactccgcggatttagtttcgctcaggtttttaatcaacacattgttgaggtaatactctccgtcatcgtaattatccagtatacctaatatattaagtaaagtagatttgccggaacctgatgctcccataatggaaacgaattcaccccgctcgatatcgagattgatgcccttgagtacgtggaggggggctccgttgttgtaggttttgttaatgtcttttaagtgtatcacagtttcatctatttagtttcaattttcttatgatttgttctattagacgcacggttgatacgaaaagttgcaaacgaagtgaacttttttaaaaaaagattttgtagactcaatcttctttacgtaatttgtgtgcaataaacatttaatattaactaaccctttaaataagagtatcatgaattcaagcatggagaaaccctacgtagtgggtattgacattggcggaacaaacactgtctttggaattgttgacgcgcgcggaactattatagcaagcggtgcagtgaaaactcaggtatatcctacagtagaagaatatgcagatgaagtatgcaaaaatcttctgccgttgatcattgcaaatggcggggtggataaaataaagggtatcggcattggcgctcctaatggaaactattataccggaaccattgagtttgctcctaacctgccttggaaaggtgtattgccgttggcttctatgttcgaggaacgtctgggcattccgacagccttgacaaacgatgctaatgctgccgctgtgggtgaaatgacttacggggctgctcgcggtatgaaagattttatcatgattactctgggaacaggtgtcggtagtggtattgttatcaacggacaagtggtttacggacatgacggctttgccggagaactcggtcacgtgatcgttcgtcgtgacggacgtatctgtggttgcggacgtaaaggatgtctggaaacatactgttcggctacaggtgtggcacgcactgcacgcgaattcctcgctgcacgtaccgatgccagcttgttgcgcaatatcccggcagagagcattgtatcgaaagatgtatacgatgctgccgtacagggagataagctggctcaggagattttcgaatttacaggtaatattctgggtgaggcattggctgacgctattgctttttcaagtcccgaagctattatcttgttcggtggtttggcaaaatcgggcgactatatcatgaagccgattacaaaagccatggaaaacaatcttctgaacatttacaaaggcaaaacaaaattgctcgtttctgagttgaaagactccgatgctgccgtactgggtgccagtgcattggcttgggagttgaaagacctgagagactaagagcgaatgaaagcgattatttagctgaaagctccggaagcaattccggagctttttttgtctgtgtgggcaggaacttcgggatgtactccaatatcgttttgtcaaaaatgtcattttgtattttctatcggttcagggcgggcatattccgatctttgttgggaaccgggtgggaaaaatgaattttagcagactcccggcaggtcaaaaagatatcttattgagcttgaccctcgccggaagaaagaaaagttcttttattttgttttgtatgatagcgaatcttgtagtctaacttcgaaatggtacttgggatacctcactccaaccggagctaataagtgaaaaatgactttgattttagactattaataacctctttggaagaagttaatgatttgtttcgactttattaataaaagactcggacgttattaacaaaagacttggacgaaattaataatctctttcgtctttttccgtatatatactctcaaagtgatcaagttctgcatgaatactctttttttattcttttttatgcaagaaagatctacagaagctctttgtttaagaaaggggtggttagcaaatcgattgaaaagagagtataatgattccattttataagatttagcatctttttgccggattccttttttatcatcttccaatgctgtaagggggggctatttgtttcttttggatttccacacatgaagactatcggaagcttttcggtgattatgctgtataagtgcttgtgccgcgaaaggtaggaatgataattgtgttacgaaataaaaaagaggaaatcttgccagaagattccctcttttttatttcgaatcgaaaagtaaggctgattagccgttaactcttttttctttgattcttgctttcttaccagtaagagcacgcaggtagtacagtttagcgcgacgtactttaccaaccttgttcacttcgatgctgtcgatagccggtgattcgattgggaaaattctttctacgcctacagttcctgacattttacgtacagtaaaacgtttcttttctccgtgacctgcaattttgataacaacaccacggtacaactgtacacgttctttgttaccttcgataatacgatatgctactgttacagtgtcgcctgctttgaagctcgggtgctgttttccggtagcgaatgcttcttctgcaattttaattaaatccattgttgtttattattaaattgttttatcgttacaacgcaacataccaggcaactctctcctgacagcgattgcgcgaaagcggtgcaaagtaacgaattatttgccggatagccaaatgtttttgtatatttgtagcattattaagtacttaaggatatgaaacaaaattacgcaaagattatttcaggagtaattctggcggggttgctgacatttacttcttgccagtcgacgcacgaaatggcaaaagccgattatcgggttgccaaggtagaaggaaggatgattgacattgacgctaaatgggatgctcatcccgatgcagatgccgtggcaatattaaagccttacaaagagaagatagacaacatgatgtatgaggtaatcggcaccagcgagcagaagatggacaaaggtcatcccgaaagtctgctttccaatcttgttgcggaagtattgcgccaggctgcggtgaaagtacaggataagccggctgacatgggattggtgaatatgggcggattgcgtaatattttgcctgccggggatattacggtgggaacggtatatgagatattgccattcgaaaattcactttgcgtaatgacgatgaagggaacacacctgaaagcattgctcacaagtattgcttcgctgaagggagaaggagtgagtggtatccggatggaaatcactaaggatggaaaattactgaacgctacagtgggcggccagccgattgatgacaacaaactttatacggtggcgaccattgattatctggctgacggtaacggaagcatggaagctttcttgcaagcggagaaacgtgtatgtccggaaggagcaacattacgcggactctttcttgactatgtgagacaacaaacagctgccggaaagaagataacttcggcactggatggtagaatcaccgtgaagtaaaggtataatagaatgtaaaatgataaaattcagtgaattatgatatccccaaccaataataaatatattcttagttttatagaaaagaattttctggctttctttttcattttctttttttctttttcagcatttgcccaacaggacaagaaactgatcctgttgcagaccagtgatgtgcatagccgtttggaacctatcaatcaggaaggtgaccggaattatgataagggaggatttgtacgtcgcgctacatttgtgaaagagttccgtaaggaacatcctgatatgttattgttcgactgcggagacatatcacaggggactccttattataatatgtttcagggtgaggtagaagtgaagatgatgaacgaaatgaaatatgatgccatgactattggcaaccatgaatttgatttcgatctggataatatggcacgtttgttccggatggccgactttccggtggtatgtgccaactacgatgtgagtgccacagtgcttaaagacttggtgaaaccatatgtaatcatcgagagagacggagttaagattggtgttttgggattgggctgccaacttgaaggcatggttcaggccaataaatgcgtgggagtcgtttataatgatcctgtagctacggcaaatgaagtggctgctgtcttgaaagaaaaagagggttgtgatgtggttgtttgtctttctcacttgggtgtgcaatatgatgaaaaccggttgattcctaaaacccgtaatatagatgttgttctcggagggcactcgcatacctttatgaaaggaccgaaaactcttcttaatatggatggcaaaaatgtatcattgatgcataccggtaagagcggcatctatgtaggacagatggacttgacacttgaaaataagaaataagagggattatccctcttgaaatacccccaaacaaactatgctaaaacaattgctaaccgctgcgttgctgctgggtgcgggtgctctttgggctcagcaaacagcaggactcttacctgtacaggaagatgtacattgcaatgaatgggtagagcaaacgctctcccgcatgaaactgaaggataaggtagggcaattatttgtttataccctggctccacggacagacaaagatactgaaaaattagtggataaactgacccgtaagttgaaagtgggtgctttcctgtattccgaaggaacggtagaaggtcaggcgaaattgaccaaccgggcacaaagccggtcgaaaattccgttaatgattacttttgatggtgagtggggactatctatgcgattggagaatacgcctgtgtttccgcgtaatgcggcattgggttgcatcagtgataatgcactgattgaagcctacgggcaggaagtggcacgtgaattccgggagatgggtgtacatgttaattttgctccggatgcggatgtcaataccaatcctgacaatccggtgatccatgtgcgttcgtttggtgaaaacccggaagcggtggctgagaaagtgatagcttatgggcgtggattggagagtggtggtatcttgtctgtttccaaacattttcccggacatggtgatacggacgtagactctcataaggcgctgcctgcggtctattacaatcgggcacgtctggacagtgtggaactatatccttttaaacaggccattcgggctggtttaggtggtatcatggtagggcatttgcaggttccggctctggaacctgatcgtataactccttcttcattgtcgcgtagcattgtgacagatgtgctgcgaggagagctgggattcaatggcttggtctttactgatgcgcttgccatgaaaggagtagcaagcgaaccggatgtgacggtgaaggctctgaaggcgggcaatgatatggtattggtgcaacaaaatatagagaaagcacagcaggatgttctgcaagccattaaggaaggacggctcagtatggaagaagtaaatgcaaaatgtcgcaggatcttaacttataagtaccgtttgggattaaataagcgtcctgtgatttcagtagatgggttgagtgatcgtatcagcactcctgaggcacgggctttactgacaaaactccgcacgtcagcagtgaccgtactggggaactatttccggattctacctcttgttactaaagatgaaatagctgtattgacggtaggtggtgaaggtagtgatgctttgttcattgaagagttacgcaccaggctgtcattgaaaacattccgaatggataaagatacgggagaggaagaacgcaaacggatagcaaaagaacttggaaaacatcggagggtcattgtgagtatgacaataaaagataaagaagcggaagaatatcgtccgttctttacagacctcaatcttcaggctcctgtagtttatgctttctttacttcgtaccggaccctggtgacacttgaagaggctgttgcccgttcggctgctgttgtactggcacattccgatgaagcggatttgcaacgttatgtagcggatgtggtattgggtaaagcttcggcgacagggcgtttgtctatgcgtatcggagagacgtttgctgccggttcaggtgtagatatagtgcccggcatgactgccggtacggctcctgaagattatggattgaaatcgtaccgacttcatcgtatagactctgtagtatctgccggattggctgccaaagcatttcccgggtgtcaggtactggtattgcgacatggacagcctgtttatgataaatgcttcggcattcattccgatacggatagtaccccggtacgtccgaccgatctttttgaccttgcctctttgaccaagacaagcgctacactattggctgtgatgaaactttatgatcagggacagttgaaattgactgatcctgcttctaaatatttgcctgctttacggaatacgaacaaaaagaatattaccattcgggagttattgttgcatgaatccggcttggttccctatatccgtttttatcgcaacgcaatcgatgaatattcagtaaccggtccttttacacaagggtttgtggatgaatggcatcatacccgtatgggggaatatacttatgcctgttcggatttcaagttcaggagagggctcgtctctgcaacaaaaacgccggaacatacgttgaaaatagctgatggaatgtggctgcacagaaagtttaaagtcgcaatgatgaagagtattgttcagtcggaactggatcgtaaacgttttgtgtatagtgatatcggctttattctgttacagcaggtggtagaatccataaccggtcaaacgctcgatgcttatttggctgctgagttttatcgacctatggggttagaacgtacgttgttccaaccgttaaaccgttataagaaaacagaagtaatgccgactgctaccaatgattatttgcgtcggcagaacctttgcggatatgtgcatgatgaagcggctgcctttatgggaggcgtgagtggcaatgccggattattttcgacagcctgcgaacttggaaagatctatcagatgattctcaatgaaggcgaactggacgggaagcgttatctcagatcggaaacctgccgtgcatttactatgggaaaatctgctgtcagccatcgtggattaggatatgacaagcctaacttgaatgatccgaaagcaaatgcctgtgcaccttcggcaccggcctctgtttacggacatactggatttaccggtacttgtgcttgggtggatccggaaaatgacttggtttatatctttctgagtaaccgtctctgtcccgattcctggaatggaaagttgaatagcatgaagattaggcaagggatacaggaagtgatttatcagtcattatatacaacagaatagctaatggctttttacaatatagaatgaaaagaagatatttatttgctggtttagtcgtatcagcgttttttgtggtaggggcgaaaactcctactttaaaagatactcctattggtgagaactttcatgctcctcccggtgtatctgctcctatagaacctttattgctttatcaggcctctcaggacgaaaaatgccgtcactgggtcgattctgtttacaagcggatgagtttgaaagaaaaggttggccaattgttcatttataccattgcacctgtgcagaccaaacggaatatgcagttgttgcgtgatgccgttcatacctataaagtcggtggattactcttttccggtggaaagatacagaatcaagctacactgaccaacgaagcgcaacggatggcacgctgtccgttgctgataaccttcgatggtgagtggggactttccatgcgtttgcgcggtactcctgtttttccgagaaatatggtattaggatgtattcaggataatcggctgatctatgagtatggacgggaaatggctcgccagtgtcgtgaactgggagtacaagtgaattttgctccggtggctgacgtaaatatcaatccggataatccggttatcaacacccgttcgttcggtgaaggtccgatgcaggtagccgacaaggtgattgcttatgcttcggggctggagagtggaaaagtcctttcggtttgcaagcatttcccgggacatggtgatacggacgtggactcacacaaagcattgcccgtattgccttttacacgtgaacgtctggacagtgtagaactatatccgtttaaagaggctatccgtgccggagtcagtggtatgatggtggggcacttacaggttcctgtaatcgaaccaatcggtggattgccctcatctttatcgcgcaatgtggtttatggtttgctgaccgaggaattggcttttaagggacttatttttacggatgcgcttgctatgaaaggggtttccggtaatcagagtgtctgtctgcaagccttgaaagccggaaatgatatggtattggctccccgcaggctaaaggaagagatagatgctgtattggcagcggtggaaaaaggagaacttccggaagaggaaattgatgcaaaatgtcggaaaatactcacttataaatacattttaggtctaaaggataaaccttttgtgagactatcggggttgggggctcgtattaatacgcctcagacacgtgatttgattcgcaggctaaatctggctgcaattacagtgttgaataataaaggaggtgtattgcctctgcatcccgacctgaaagaggtagctatattgaatgtcggtgatggcgggaaaacagaaccttttgaccgcgaaataaagaagtatattccatttacgcgttttcaattgcgtaaagatttgccggaggtcgaacagcagaaactgcgtgattctcttgctgcttatcgccgcattattgttactgttaccgagcaacgccttgctccttaccaatcattttttgcccggtttgctccggaagctcctgcaatttatgtgttctatactccggctaaatccatgttgcagatccagcgggctgtatcggcggctgaggctgtggtactggctcatgctcctcatgatgatgttcaggaacgtgtggctgatatactttttggcaaagcgacagcagacggaaggctgtctgccagtgtgggtggattgttttctgccggttcgggagtgacgatcacgccgcatacgccttttcattttgtacccgaagaatatggtctgaaatcggaagtgctaagtcgcatcgattcaattgctttggaaggtattaaagaaggagcttatcccggttgccagatactggtaatgaaggatggtaaggctttatatgaccgatgtttcgggcaccatacagataagcatagtgaaaaagtgaaaccgaccgatctttatgatctggcttcactgtcaaaaacaacaggtacattgttggctgtaatgaagctctatgataaagggtgctttaatctgactgataaagtgtctgattatctgcctttcttgcgtaagacgaataaggagaatctgaccattcgtgaactactcttgcaccaatcggggttaccttccggattagtcttctatcaggaagctattgataagaaaagttataaaggttcgttgttcaagcagtcaaaggatgctttgcatacggtacggttaggtgctcgtacttggggaaatccgaggttccggttcaataaagggatggcagccgagacgaaaagcggagactgtatccttcaggtttgcgatagtctatggttgaatcagtcgttcagggaagagatgcagagaaaaattgcagaagtaccgttaaaggataagaattaccgttacagtgatatcggatttatcttgttgcagatgcttgcagaagagttaagtggtaaaccattggatgaatatctgtggcaggagttctacaaaccgatggggctggagcgtactgcatatttgccattgcgctacttcgaaaagaaagagattgtaccttctgctgtagaccgtttcctccgtaagaccactttgcaaggttttgtacatgatgagtcggccgcatttcagggaggtatttcaggaaacgccggacttttttctacagctcgtgaggttggtaaggtctatcagatgttacttaatggtggtgagctggatggacggcgttatttaagtaaagagacttgtgctttgttcactaccgataaatctaaaatcagccgccgtggtctgggctttgataaaccggatgtggtgaatgaaagtaaaagcccgtgtgctgtttctgctcctgcttctgtatatgggcataccggatttacaggaacctgtgcctgggtagatccggataatggtttggtttatgtgtttctgagcaatcgtacctatcccgatgcttgggttaacaaattatctaaaatggcaatacgggaaaaaattcaggaaaccatttatgaggcgatgaagtagaattaatcattacatatgccagcgtattataagtcaactcttggtgaggaggtatctcactgagatttgatttataatgctttatgattcatgatgttttgtgctttgatatttttatttagtactataactccaccgtgatagcttctgacaaatgtgaatagcattcttttaatgtaaataatttagcctgagatgggtgtgggatagagaaaagtattaaaatcaatagtaaaaagagcattctcttctaagttctatcagaactttccgaaaggagttaggggaaattggggaacattttctcataagtattaatatttaattggttttgagatagcaatataggatctgtttggaatcggttaaatatatgtttgtttactatcctaatcctatttttctacctgtattagatttaactttcgcagacaaagttaactctattttttataaatacaataaacaatactaaaaaataatataaaagaagtcccctgttggagtgaatgtttccccaatatgaatcaaaaagtaatataaaatgaaaatggatgattacatattgttttaagttctgataggacttggcatttctgccggcctactctctccgaaccatgtgttcgctacgtctttagagacttatgagaaccagtctgttgctgccattcagcaagcaaggaagattaccggtactgtaaccgatgctgccggtgaaccggtcattggtgctactgtcctggaaaagggtaatgcttccaatggtacaattaccgatattaatggtaaattctctctttctgtttcgggcaatgccgtaatcagtatttcgtatataggatacataacgcaaaatattaagataaccaatcagagctcactcaaagtgatattgatggatgatacccaagcactggaagaagtggtagtggtaggctatggctctcagaagaaagcgaatctgaccggtgccgtatcttcagtcaaaatggatgaggtattaggtgaccgtcctatcttgaatgcatccgatgctcttcagggagctgtcccgggattgtttgtttctaacggaggtaatgctcccggaacaagtaaatctttccagattcgtggtgcctattctgtcggcgtcaagaactcggacggttcatatggtaataccattaagccactggtactgatcgataatgtggaaggtgatcttgacatggtcaatccggaagatatcgagtcaatcagtgtattgaaagatgctgcttctgcggcaatctatggtgcacgtgctgccggtggtgtaattgttgtcacaaccaaacgtcccaaaggtgccgctaaattctcattgaattacaataataactttgctttcggaacagctgtcaacctgcctaagcaagctccgttgatggattatctgcaagcttatctggattgcggatattcggatgcttactggtcgctcggttcgccaagtgtcagtaaatggatggagtatcttagtgaataccagaaaaatccgtctgctttcaatacggtaggtgatggtatctatatggatgaatccggtgtaccttattatctgaatgagaaagacctctataaaaactttatggagaccagtttccagatgacccataatatttcggcctctggaggtacggacaagctccgttatcgtatttcgggaggatatacttcaaacgatggtgtgttgatatccgatcgtgataagtttgagcgtatgaacatcaacacctttatttcggccgatgtgactaattggtttactcaggaagtgacaatgagctatgctcacagtttgcaaacttcacctggtggaatgggtggtgtgtataacacccgtttgatttcatactatcccgaaggagatttgccggcatcggttaatactttggcaaacgaagaccttcctttgtttaccccgcggaatcagattttactgtcgaacccggtaaacaacaataatgataatccacgtatcttcttgaaatccattctgaaaccgcttaaagggctggaagcagtatttgagtatacgttcgataaaaacatttatgattatcattggtatacagggcagtatgattataccactatccagggaggaagctctaaatcttttgtagacgattatctgagaaaatacaaacagcatacgaattataatgctatcaacgtgtatgctacgtatagtaagaactttggcagtcataattttaaagtaatggccggattcaatcaggaatcgagctatcaagagactttggatgcctactcatacaatcaagctgtgattgatgtgccggcaatgggctccggaaccggaaccatcaagactactgactcatatagtgagtatgctgtacgtggtggctttttcagggttaactataactatcaggacaaatatttgctggaagtaaacgggcgctatgatggttcttccaaattcccgaagagttcccgttttggcttcttcccttcagtgtcagccggctggcagatagcacaggagaagtttatggagtctacacgtaactggttggatgggttgaaagtccgtgcatcatatggtgttattggtaaccagaatgtgaatccatatacattcactccgaccatgagtgtcagcaataagtctacctcctggattatcgataatacgtatgttacctctatcagctcgttgcctgcattggtaagccagaactttacctgggaaaaagtaggtacggtcaatgtcggactggacgtgaatctattcaataatcgcctgaatggtgtatttgaatggtatcagcgtaatactaacggtatgcttgctccgggcgtacagttgcctgctgttgtaggtgccagtgctccttaccaaaatacggccgatatgcgtacccgaggttgggaactgagcctgaactggcgcgaccagatcggcaaagtaggatatcgtcttggttttaacctctctgattataagtcgaaaattaccaaatacgatgacaatgcggccactaaactgttaagcagtttctatcccggacaggtgatgggtgaaatatggggttatgtagcagacggctattatacagtagatgattttgaagatacttcgtcctggaaactgaaggaaggcataacttcgattaatggttataacgtccgtccgggtgatgtgaaattcaaaaatcttcgtgatgatgaaagttctactaatgttattacaagcggtgacaacacattcgataatccgggtgaccgcaaagtgattggtaatacgactccgcgttatcagtatggtattaatctgggagccaactatgccggttttgacctgaatgttatcttgcagggaaccggaaaacgtgattactggatctcgaatgttctgactttcccgatgaacggtgataactttattcctctattcgatgggctgggtgactattggaagccgaaagacccggataacggtgactggacagcagttaatccgaatgctaagtatccccgtctgtatggtaaccgtggtaattcaggatcaaatcttcgtcaaagcgacaaatatttgtccgatgcttcttacctccgtatcaagaacattactctgtcctataacttgcccaaaaagtggctgtctcagatcttcctgtcacaaatgaaagcgtttgtcagtgttgaaaacgtagctactttcacctctttgccttcgggtatcgacccggaaagaatagaatggaactatccggcattccgcacggtttcattcggtataaatgtcacattataaactctaatctgatacacgaatatgaaaaagatattattgtttttaacccttttcgcggggatgatgctgtcgggatgcaacgatagtttcctggagaaatatcctgtaaccagcctgacggaagaaaatgccttcaaatcttatgacaattttaaggcctttatgtggccatgttatgaaatgttttctaatacgaacattgctacttctaccactgcaatcgggcgtaattctcattacttgggtgatgtgtatgccggatatctgaatcagcgcggagccagcagccagaataaatatgcgttccaaacggtgactaatgctacatcaggtaatggatggaatttttccacctttatccgccgtattaacctgatgctttcacatgtggatgcttctgatatgacggaagctgaaaagaatcactggaaagccgtcggatatttctttcattcattctggtatatggagcttatcgatcgtttcggtgatgtaccctggattgataaaccactggatgaaacctcagaagaggcttatggtacccgcatgccacgctttgaagtagccgataaagtgctggagcgtttacaatgggctgaagagaatatcggtgatgcatcggtttacgagaaaaaagacggttcgaataccatcaatcgcgactgtgtgcgtgcagctctttcacgtttcacgctgcgtgaagctacctggcgtaaatatcatgaactgggaagttatgataagtatttcactgagtgtatccgtgtatccaaactgttgatggcagactatccgacattatattatggaactgacggacaaccggcagccggatatggtgagatgtggaccacagaggacctgagtaaggtacaaggcgttattctgtatcagcagtggctggaaacaataaaaccgggacactcgtgctattatgaacatacttcttcgcacgacatagaaatgcatcagggaacagtggacctgtatttgtgtaaagatggaaaaactatttctcactcagatttgtataagggagacaaagatatttattctacttttcgcaaccgtgacccgcgtatgtatcataccatcatgcctccttataaagtgaaagacggtaagggagattatgctacatggtcttataccagtgatcccgccgaccgtgaatatatcgacatcatgggagcgaatgagtcgtgtagcaatccgggtatcggtatgaaacgtttaccgggacagaactggagtgcttcattggtacgccgcgttccgaatttgcagggaggcgcacaatatacgattgaaggaaagaaatatggaccacatgcttatgttgcttgccgttcgggatattatgtatggaaaaactgggataactgggaagaaaattataacaatgcccaagtgaacactgccgataaacctgtctttaaaattgaagaggttttgctgaactatgccgaggctatgtttgagaccaaccagttcacacagacaattgctgacgagacaatcaataaattgcgtaaacgtgccggtgtggccgatatggtagtggcgcagattgatgctaattttgatccgaatcgtggaaaatattatccgaagggaaatgataatggaattctcgttgatccggtattgtgggagatccgtcgtgaacgtattattgaactgatgggagaaggattcggtttctacgatgtacgtcgttggagaatggctccttggtttgtgaatatgcagcagaaaggtatgtggatttcgaagagcgaactcagctcactgacactgcttaacgaaatgaccggaacatcggatggggcaaatggatctatgaccgaaggttatatctatctgttcaacgatccgttgaaagaaggaaaaggctggcttgaaaaatattatctctatcaagtcccgttggaagaaatagcgcttaatcctaatctgactcaaaacccgggctgggaatagaaagatctttatccgttcttttaaattaaacaatgagagaagaagagtggcgaaactggctttagtagcgccctcttccttctgttttgaaaactttaaatacatatcatgaatcagaaattattactcggaagtgcattgctcgtagggatggtttctacacaacaaacgttggcacagaaaaagaaagcacaggggcaaacccgccctaacgttgtttttatactggctgatgacctggggtacggagatttgagttgctatgggcaagagaagttcgaaacccctaatatcgaccgattggcacagaatggcatgcgtttcacccaatgttactcgggaacaacggttagtgctccctcgcgttcgtgtctgataaccggaacccatagcgggcacacagctattcgcgggaacaaagagcttgctccggaaggacaattcccattaccggaaaactcacagaccatctttaatgattttcgtaatgcaggttatcgtacaggtgcctttggcaaatgggggcttggctacatcggttcggcgggtgatcctaacaaacagggaatcgatcaattttacggatataactgccagttgctcgcccatagttattatcccgaccatttgtgggataatgataaacgtgtcgatttgccggataacaatttaaacgtgcaatacggaaagggaacttattcgcaggatctgattcattctaaagcattggctttcctggatgaagcagctaaggataaagataaaccgttctttatgtggtatcctactattatcccgcatgccgaactgatagtaccggaagatagtattatcaagaagttcagggggaaatatccggagaaaccctatcgtggagcagagcccggcagtcccggttttcgtaaagggggatattgtacccagttctatccgcatgctacttttgctgcaatggtttaccggttggatgtatacgtagggcagattgtacagaaacttaaagatatgggagtatacgataataccattattattttctcaagtgataatggtcctcacatggagggcggtgccgatccggatttctttaacagtaatggtatctggcgcggatacaagcgtgatgtatatgaaggtggtattcgtgtacctatgattatatcgtggcctggacgtgtacagccaaatacggaaaccgatttcatgtgttcattctgggatttgatgcctactttcagggaagtattggatccgaaagtggatactcggaatatggatggtgtcagcatacttcctttgttgcaaaaccgcaaagggcagaaagagcacgaatatctttattttgaatttcttgagatgaacggacgccaggctgtccgcaaaggcgattggaaactcgttcatatgaatatacgtggaaacaaaccctactacgaattgtataatttagcttcggatccgtcagagaaacacaacgtgctgaacctgttccccaagaaagcggatgagctgaagacaattatgaaagaagctcatacagaagatcctaattggcctttatttcgataaatagtgattgataaagttgtcaaaatgaaaggcaagcatgtattgctttaaaaggaaggggctgttatgtgatataacagcccctttatgtatatatagtcaggtacctctgctctttttagaaagcaagacctaccctgaagccgaagttgttcagtttgtctacattgtaagtcaacacgttggctttgttggtagcatagctgtaataaacagcgatgtgcaggcccgggccatatgcccaagggtaaacgttcagaccgagttccggtgatacgtaaaatccccaagtattgtcgcgggtttcgaacatattgtagttagaacgtactttcgcatagttagcacctagtttgacaccaaagtaaggctgccatgctcccccacgattcaactgatagcgtgcagcggcaccaaaaggtaactggaagatggtatgctgctggtcagtattcacggttccttcgcccacagggaaagttgcgcgtgggaagtattcgtgattgctgctatagttcataaagagacccagtccgaggttaggggttacaaaataaccgccttcgaagttcataccccatccactggctttatcggcaaagtgatttttcaatggcacgttgaactgccagtccacgttagcgtatccattatctgataactgtgccttggccggcatggcaaaggccagagcaagggccgctatggccagtactctaagagaaatatatttcattgttttcataacggttcttaattaaattatttgttagtgagataaggtgactgtgcaaacgactgattgattgcgcgaacaaccagagtctggttcactttgccggaatagcttgcaggaccgctcaggaagctgctccacagaaccggaagtttctgattatcaccttcgggagccttcaggttcatgatttcagtcaggaatgagttggttgtaatgctatagttcacaacatacggatagtaccaaccgccccagttaccccagtaaggtgcatcccaatagccgggatagttccaccaccattcgggttgtccgtagtcggtaaagtaataagtactctgaacgtaactaatctgcacgcccagatcggcagcatctttattgtcagtataagcaaaacctttgctgttcaggttgtctttgtatgcattgataatggctgctgctgcttcacctttccagtattccggatcttttttatctcctattacgagaacgctgtcagggatgtagtacgtgctgaactgtttaaagtcagctttcttgtcgtagttggtataaaccaaatagtcattgtccaatttgtccatgtcagggtctttttcgcaagctgcgaatgcaaagaccgccaataagatgggaattaatctcttcatatctttataatgtttaggttattaaaaaaaatcttgccctggtaccttaaggcgtttgcagaaaataacaagactcttgttaaaaggttcgcaaagaataatgttaaaatgcagtatgattacttggagcctttggtgaaagatctatctttgtacaaaattaaaaccgaaataaatatgaagaacctacgcatctgccagacattttctctttggctcgttttgcttgctacatctttgtctctatccgcccaaacaactttattggataagttgggtaagattaccgaaatcaccaagacccaacccttggaatctacagagtttgttgagaaatatgtggcttatttcacccagccgttagatcatcatcatccagagaagggctctttcagtcagcgtgttattgtttcccatgtcggattcgatcgtcctactgtgatggttaccgaaggttatggcgcttcttatgctttgggaatcaattaccgggaagagctatcaaaactatttaataccaatatgatatttgtggagtatcgctatttcctcgaatcgactcctactcctaaagattggcaatatctgacagccgagaactctgctgaagatttacatgccgtgcgcgaggctttccgctccatctatcccggtaagtggattgctaccggcatcagtaaggggggacagacagcgatgctttatcggactttctttcccgaagatgtggatatctctgttccgtatgtggctccactctgctatggagtcgaagacgggcgtcacgaaccatttttaaagatggtatctactcctgaggctcgtgagaaaattgaaaattttcagttggaagtgttgaagcgtaaacctactttgctacctcgttttgagaagtattgtgccggaaagaaatataaattccgcgttcctgtagaagagatttatgattattcagtactcgaatattcgttttctatctggcaatgggggaccccggtcgatcagattcctgcaattacggcctcggatgacgaactctttaaacatttgcttgcaattagcgaaccgtcttattttgaggaagagggtgccaatacttccttctttgtccaagctgcccgcgagttggggtattatgggtatgatatccgtccattcaaaaaatatcttaccattaaaaccagtgaagattacttgaagcgtttgatgcttcctgaagaactcggcaatatgaagtttgataagactctgagccggaaaataattcatttcctaaagaaaaatgatccgaggatgatctttatctatgggcagaatgatccatggacggcatcaggtgtcacttggctgaaaggaaaaaagaatattcatgtctttgtgcaaccaaacggaagtcatttggcccgtatcggcactttacctcaaaaagagaaagaggaggctatcgagttgataaaagaatggttggaagagtgattccattcttacccttctgtaaatgaatagaaaagttacaggggtgttttcaccacagattacacaaatttatacagatgaaaagcaactggattattgcccatacagataatcagtgtaatctgtggtgatctctgatgttacaaacttacatcagcggtttcaatatctccggcacctctactttgtccaggtccagctcgtctaaacgcttctttcccgcttctgtcaggctgaaatacatttgacgtttatctacttcacccaatgagcggcggataagtcctttatcctccactgcacggatgactttcgacgtatgtgatggagccatttccgttcgttcggatatggcggtcgatgtaatctcttttccggcttcacgtaacgcacatagcaccattgcttcgttaagcgatatcgcatacatctcctcaaatgctgtttcgaatacagagagagctttgtagatatcgcgcattttacatattgtattcatacttctttattaaataaacaaattgatgttagcattatcggcacgctccatgtaagtggccactccacctactgtaacctcatcgagcagttcttcacgtttcactcccatgacatccatcgacatctggcaggctatgaattccacaccgttttccaatgcctgttgccgcagggattccagtgagtcgatgcccttgcggtgcatgatgtatcgcatcatctttccgcccatgcctcccatattcattttcgacagcttcagtttcagtgaactcgatggtaacatcattccgaacatcttgccgaaagcgtctttctctaccttgtgtttatgaagtttcttaatcacattcagtccccagaaggtaaagaagatagtcactttctgtccggtcgcagccgcaccgttggccaggatgaaagtagcaagcgccttatccagatcgtcgctgaacataatcaacgtttttcctttgctgtcacacgttgtagtgagactacaggctttgggctctcctttttcaataattactaccgacttcccgtctgcactctcttttgagatgaaattatttccagtcgagttgcaccatgctgcggcatctcgtgagaatcccgggtctgtagctacaatttccactcgttctcccggggcgagtgtatccattgttttcttcatttttaagattgggcccggacattgtaatccgcaggcatccactcggatgattttagacattgcaacgggtgcagcctgcatcttttcagcagaggcaggctgctttacctgactttcttgagtaatagacatgttttccgttgcttcatcttcgtgcaggatgataggagcagtagctgcacggtatgtttttagtccgccggaaagattatatacatctttgaaaccatgctgaatcaggatacggtaagcgagataccctctcaaccctacggcacagaaagtataaatgggtttctcagaaggtatttcgcccatacggtcgcgtatttcatccaacgggatattgaccgctcccggcagcgaacccagtgcgaattcatccggtgtacgcacgtccagcaagaatacgtttttcagttcgatgtctctcaggtcacgccagtatatgggtttcactttgccaaggatgatgttttcggctacataaccggcaatagccacaggatcttttgccgaagagaaaggaggggcatatgcctgttccactttcatcaggtcatagatcgttcccccgtgcttgatgacgagtgagagttcatcgattcgcttgtccacaccatcgtatcccacaatttgcccgccatacaacttgcctgtttgaggatcgaaagttatcttgatactcatcggcatagcgttcggatagtatcctgcatgtgaagccggatgtgttgttgaagaagcgtatgagatgcccgcttgtctcagccgcttgccgggaaggccggtagaggctaccgtcatgtcaaatacttttgcgatggatgtaccgatggctccttcataagagattttcgctcccagcagattgtcggcaacgatacgtccctgacgattagccggtccggcaagatagttcagacagggcttgcctgtaatggggtgacggaattcgatagcatcaccgatggcataaatcgattcatcggaagtctgcaaattgtcgttcactgcgatgccacccgcttcgccgattgtaagcccggcagcccgtgccagtgtagtttccggacgtacaccgatggagaggatcacaatatccgccggaatagactgtccgtttttgaagatcactttcacctctttgcctgcttgttcgaacgaagccacagcctgttccagatataagtttacacctttctccatcaaatgttgatgaaccagtgccgccattgaaaagtcaataggtgccatcacctggttgcccatctcgacaatagatacttgtgctcctaatgcatgcaggttttctgccatttccagtccgatgaatccggctccgatcacgacagcccggcggggaggccgactgttgacgtatgctttaatgcggtcggtgtctgctacattccgcaaagtaaagataccgcttgagtcaatgcccggtaatggtgggcgtacaggagatgcaccggtggatattaacagtttgtcataactctcctcgtaagtgtcttcactcttaaggcggacggtcactgtcttttttttccgatctataaaaataacttcattttcggtacgtacatccactctgaaacgtactccgaaagcctcaggagtctgcacgaataacttctcgcggtcttcaataacgtcacctatataatagggtagtccgcagttggcataagatatatattttcctttttccagtaagatgatttctgctgtttcatccgaacgtctgatgcgagccgcagtagtagctcctcccgctacgcctccaataataatgatcttcatttgaatatgttttcgttttaaaatagtttcctttggaaataaacgtttataggcttcaaaaggttcatgggatgtacaggaaattatccggcatccgctctcttatcttactgagatatggttgatttgaaagacggctcttttatcccgttattatctgtggacagacatgaggatattcgtattctcaatatccctatattagtcaacttttctttagaagaaaagatggtttgtccgtgttgttccacttactgcggtttaatgtcggggcacatgtatgagagaccattgtagctgaaggcttaaacaaggtatcgttcagtagttgcaatgcctctttcttatcttctgctttgataacaagagaaacgtcgttattattactaccataagaaatcatccgaatcgggatggctgtcagagcgtttaggattcgggtctccaatccggtatattgccattgtatgtttccaatgaccgacaggatgcacatacggtcctttactaccgtagttgcgtatcgcgaaagctcatgcaggatatttggtagatgttctttatcgttgatggcgacggatacatccgagccggacgaagtaaaaaggcacaggggagtgtggtattttgcaaaaacatcgaatatcttgctgatgaacaagtagggacgcaatgtccggttcgactggaatctgatgtaacaaataccgtctctggcagtaatggtttttatactttctccgctctgtatgtgtgaaatcagagtacccttttccgtgggatccattgaacagaacaggcgtatcggtatattgctttctcttgccgggaaaatgcagcagggatcgaatcccgttcctccgcaatgggcgaatcgttcggcttcgtcgaaactgagttgtgtaaccatagccggatgtttcacgaaatgcggatcacaactgtgtatgccattaccacctatccatagccgtatttcttcggtccgtagggcggctccgattaatgtggcagaagcatcgtctccacccggcttgagaaaacaggtttcgccataagcattccggcagaggtgtccttgggtaagaaacacgttgatgtgtttgttgtcttccatggatgtgtgcagttttttattgatgtattccaagtcaggttctccttccggagtcaatcgcataaagtcaagactgttaagcaatagattattgattccccgttctttcaaataaaggcttgacagcatgctgcttatgaattctccttgcgacaatatgtctttttcatcgaccgatgtaaaacgttgccgggtaaagttccatagggtacggaagcggtcgatgatggagtcaacagcttgttgtttgatcgactcgtcgttgaatagttcgttagcgaaatcaatgaatctgaattccagtttgcttatttcgtcatgcgcccgttctgtatctctgctgaaaagatgtgctgctattttcgttagatgctccgtagtttctgtaggggcagatagaacgattattttgggtgtactgtcgttgaccagttggagcatttcctgcattccccggattgaaccagtgggaatattaccgaatttgtagatcttcatttttttgtttttgagttatacgatatattttctttgttcgttacccctttccattttaggttgtttttatcaaaatgggagggaatataagtacctgttccggctgtatcttgcccattgaaagcgctgctgtactatttgtaaggcagattagacgaattttcagggactatgtcatgaatgaaagatcaaagtatatgccattgaaggttgtttttttccacagtccgatcatttgcattgtagtagaaaaccattatatttgcacaccctgttttttaccgttcacattttaacttatcagacatgagtaaaattctgattatagatgacgaagttcagattcgtggtctgctggcccgtatgatggaacttgaaggttatgaagtgtgccaggccggcgattgcaaggcagcgctcagacaattggaacttcaaatgcccgacgtggctttgtgtgacgtatttcttccggacggaaacggggtagacctggtgacggaaataaagaaaaaagcacccggagtagaaatcatcctgctgacggctcatggtaacatacccgacggtgtgcaggccattaagaacggagctttcgattacattacaaaaggagatgataataataagatcattcctctcattagtcgtgctgtagagaaagcgcgaatgaatatccgtttggataagcttgagaaaaaagtcggactgatgtattcgtttgacactatacttggcgaatcgaaggcactgaaagaagcggtgtcactggcacgtaaagtatcagtgactgatgtccctgtgttgctgacaggtgaaacagggaccggaaaggaggtctttgcccagtcgatacattataacagcaagcggtcgcagcagaattttgtagcggtcaattgctcttcattcagtaaagagttgctggagagtgaaatgtttgggcataaggcgggttcgtttaccggtgcgttgaaagataagaaggggctttttgaggaagccaacaatggaacaatctttttggatgagattggtgagatggcttttgaattgcaggccaaactattgcgcatcctcgaaaccggtgaatatatcaagataggagatacgaagcctacccgcatcaatgtacgcatcattgctgctacgaatcgggatttacctgctgagatagcagccggacgcttccgtgaggacttgttctatcgcctttctgtatttcaggtacatcttccgcctttgcgtgaacgtacgggggatattaagattctggctgaatcgtttgtccgttctttctcggagaagctttcacatccggtgggtactattacgcctgcttatcttgaggctttatgtcaacaaccgtggaaaggcaatatccgcgaattgcgtaatgccatcgaacgaagtctgattgtctgtgagggtgattgtctggatgtagacgaccttccgcttgaaatacagaacagccattatgagaaatctgatgaaggaatgccgggcagctttgaactttcagccatggaacgcaggcatattgccagggtattggaacataccaaagggaataagactgaagcggcacgtttgctaaaaatcggattaactaccttatatcggaaaatagaagaatataaacttggcagttgagcggacaggaatatacttgcttgcccgggtttatgcttttctccctttcaaaataaaacataccttttcaaaatgatagggtatccttgcactgacgaggataccctatttgttttatctgtctgtatgttagttgattatgctaaatctcttcatttttggcacacatttggcattaattgtttcaggtaaaatagaaatataaacattctaattaaaaggtaaagaacatgggaataacagtttcatttattttctgcctgttgagcggcatcgtctgcttctggctgttttggaaatgtgtcgattggtttgaaacaatttaaagagagaggagaattaagtttatgtacacaacactatttgtaataagtattacacttttcggctatttggcgtatgtgctcattcggcctgagaagttttaattggaagtaaagcaatgaatacagaaattttaggagtggcggtgcaaatcgtcctaatggtggtcttagcttatcccttgggacgttacatagcccgggtttataagggagagaagacttggtcggactttatggctcctgtagagcgagtgatttataagatatgcggtataaatccgcaagaggagatgaattggaaacagtttctcaaagccttgttgattttgaatgccttctggtttgtatggggaatggtactgctggtatcacaaggttggctgccactcaatcccgatggtaacggacctcagacacccgatcaagcattcaatacctgcatcagtttcatggtaaactgcaatttgcaacattatagtggtgagagcggattgacttattttacccagctgttcgttattatgctgttccaatttatcactgctgctacagggatggccgctatggccggtatcatgaaaagtatggctgccaaatccaccagaacaataggtaacttctggcatttcctggtaataagctgtacacgtattttattacctctttcgttgattgtcggtttcgtcctgattttgcagggaacaccgatgggatttgatggtaagatgaaggtgactaccctggaaggacaggagcagatggtatcgcaaggacctgcggctgcaattatccctattaaacaactgggaaccaatggtggcggttatttcggggttaattcttcacatccgctggagaaccctacttatctgactaatatggttgaatgctggtcaatcttgatcattccgatggcaatggcgttggctttgggcttctataccaatcgcagaaagttaggatatagcatctttggagtgatgctgtttgcttatctggccggagttttcattaatgttcagcaggaaatgggaggtaatccacgtatcgatgagatgggagttgttcaggatcatggtgcgatggaaggcaaggaggtaaggcttggggccggagccacagcattgtggagtgtgactacaacggttacctctaacggatcagtcaatggcatgcacgattcgactatgccgctcagtggaatggtcgaaatgctgaatatgcagattaacacttggtttggtggtgtcggtgtcggatggatgaattattataccttcattattatggccgtgtttatcagtggcttgatggtgggacgtacacctgagtttctgggaaagaaggtagaagcccgggagatgaagattgcaactctcgttgctttgctccatccgtttgttatccttgtgtttactgccatttcaagttacgtttatacacatcatcccgattttgtagagagtgaaggaggctggttgaataacctcggtttccacgggctcagcgaacaactctatgaatatacctcttcggcagccaacaatggttccggttttgaggggttgggtgataatacttacttttggaactggacatgtgggattgtgcttatcctgagccgttttattccaattatcggtcaggtagccattgcgggacttttggcacagaaaaagtttattcccgaaagtgccggtacattgaaaacggatactgcgacttttgccatgatgactttcgctgttatctttatcgttgcagccttgtctttcttccctgtgcatgcattaagtacgattgccgaacatttaagtttataagaatagcaggataatatagttatgaaaaataaaatgtcagcttctatgtttcaaaaggagcaagtaatggaaagtatcaagcaatcgtttgtgaagttaaatccgcggatgatggtaaagaatccgatcatgtttacagtagagatagttacccttattatgttggtggtgacggtgttctctctgttcactttggagtatggtgctttcggatataatttgtgtgtattcctgattttgtttatcactttgttgtttgccaactttgccgaagcgatagccgaagcccgtggcaaagcacaagcggatagcctgcgtaagacacgtgaggaaactcctgccagactggtgatgggtgacaagattcagacggtgagcagttcaatgctgaaaaagggagatatttttgtgtgtgaggcaggcgatacgattcctgccgatggagagattatcgaaggattggcttcgattgatgaaagtgccattaccggtgaatctgctcctgtgattcgtgaagcaggtggagataagagttcggtgaccggtggaactaaagtgctttcggatcacatcaaggtattggtgacacaacagcccggtgaaagttttctcgacaagatgattgctttggtagaaggtgccagccgacaaaagacaccgaacgagatagctttgaccattctgttggccggttttacacttgtgtttgtcatcgtttgcgtcactctgattccgtttgctgattataccagtcttgagcatcctggaacggccatctcgatcgcagctattctttctctgtttgtctgtttgattccgactactatcgggggactgctttctgcaatcggtattgccggtatggatcgtgcactgcgtgccaatgtgattacgaaatcgggtaaggctgttgagacggcaggtgacattgatactctgctgttagataaaacgggtaccattacgattggtaatcgtagagcgacaaaattccattcggcaccgggagtcggtccgcgtgagtttattacgacctgtctgctggcttccctctcggatgaaacgcctgaaggtaagtccatcgtagagttaggacgtgaatcgggggtacgcatgcggagtcttaatacgactggtgcacgcatgattcagttcactgccgaaaccaaatgttcgggggttgatttgtccgatggtacacaaatccgtaaaggggctttcgatgcaatccgtaaaataacggaggctgcaggaaataaatttccgaaagaaatagaagaagtgatagctgaaatttcgggtaatggcggtacaccgctggtagtgtgtgtcgaccagaaggtaacaggggttattgagttgcaggatatcatcaaaccgggaattcaggagcgttttgagcgcttgagaaagatgggagtgaaaacggtgatggtgaccggtgacaatcccctgaccgctaaatacattgcagagaaggcaggagtagatgatttcatcgccgaggcaaaacccgaagataagatggaatatatccgtaaggaacaacagtcaggtaagttggtggctatgatgggcgacggaacgaatgatgctcctgcgctggcacaggctaatgtcggtgtggcaatgaacagtggtacccaggcggccaaggaagccggtaatatggtcgaccttgataacgatccgacgaagttgatagagattgtggaaatcggaaagcaactgctgatgactcgcggtacgttaacaactttctctattgcaaacgatgtggccaaatactttgctattgtgcctgccctgtttatggtggctattccagaactcggtgcacttaatgtcatgaatctgcacagtccggaaagtgcgatcctttcggctgttatcttcaatgctattattattccgatcttaattccattggctttgaaaggagtacagtataaaccgatcggagcatcggcactacttcgtcgtaacctgctgatttatgggttaggaggggtgatagttccctttgtcggaatcaagttaatcgatttggtagtcagtttattcttctaaatattcaaacaatgaaaacattattaaaatctatcaagataacgcttgtgttttgtgtattcttctcagtgttctatattctcgtgttatggttgtttgctcgggtagccggtcccaatcagggtaatgcggaggtggtgacattgaacggtaaagtggtcggtgccgccaatgtcggacaaaaatttacggaggatatttacttttggggacgcccttcatgtgcaggtgacggttatgatgcaaccagttcatctggtagtaataaagggcctaccaatccggaatatctggcagaagtgaaatcccgtatcgacactttcctggttcaccatccatacttgtcccgtaaagatgtgcctgccgaaatggtgacggccagtggttcgggactggaccccgatatcactcctcagagtgcttatgtgcaggtaaaaagggtcgctcaagcacgaggaatggatgtagaggaagtcagaaggattgtagataaggcagtggaaaaaccattgttaggggtattcggaaccgagaaagtaaatgtattaaaattgaatatagctcttgaagagacaaaagtaaacaggaaatgaatatgagaaatattataaataaaaacacgattttaacatcactggcacttgtggctatgtgtttttggggaggcataaatgcaaatgctcaacagttcaatgttcagggcgatctggtaagctcttacatttggcgtggaatgtatcagacaggggtcagtattcagccgactctggggttcagtgccggaggcttttcgctgacggcatggggatctacagattttgacgggacttccgcttcggccggagctgctgccaaagagatagatttgactgctgcctatactttaggtaattccggattgactttttcagttgcagatttatggtgggcaggacagggagcgcgtaaatactttaattttaaaagtcatgaaaccgctcaccattttgaagcaggacttacttatgccgtccagtctgaaaagtttcctttatctatagcatggtataccatgtttgccggacaagataagaatgcggaaggcaaacagaattactcgtcttatgtcgagtttaattatcctttctgtgtaaagatggtagatctgaacgcaacttgcggtattgtcccttatgcggctcctcagtacaattgtgatggatttgctgtgaccaatgttgctttgaaaggaactacccggatcagattcaatgatacgtttgctttgcctatatttgcacaggttgtttggaatcctcgtatggaagatgcacatttggtgtttggtatcactttaaaaccgtgaaatcagatataacttaaaaactcatgaagttgttagccggcccgtagcagtagtgatactgttacgggttatgcagtataaaaaatgaataaatatggatagagaagagagtgtacagcatttcctcgatttgataaagagatcacgtcgtggtaagttcaaggtttacatcggtatgattgccggtgtaggcaagtcttaccggatgcttcaggaagcacacgatttgattgatagtggagtagatgtccggataggatatattgagacacacgggcgtgccggaacggaggccgtattggaaggcttgccggttattccgcgtaggaaactgttttataaagggaaagagcttgaggagatggacttggaggcgattatccgtattcatcccgaaattgtgatagtggacgagctggcacatactaatgtggaaggaagtctaaatgagaaacgttggcaggatgtgatgacattgctcgatgaaggcattaatgtgatttcggcagtcaatatccagcacattgagagtgtaaacgaagaagtgcaggatatagcaggcattgaagttcgggaacgtatccccgatagcgtacttcaagaggctgacgaggtcgtgaatattgacctcacagccgaagaactgattaccaggcttaaagcggggaagatatataaagcggagaagattcagaccgcactcaataacttttttaagactgaaaacattttgcaactccgtgaattggccttgaaagaggtcgcattgcgagtagagaagaaagtggaaaatgaagttgtgatgagcattggccttggggttcgtcatgaaaaatttatggcttgcatcagtagtcaggaaaaggctccccggcgtattatacggaaagcagcccgtttggctacccggtacaacacctcgtttgtagcactctatgtacagactcccaaagagagcatggagcgtatcgatctggccagtcagcgtcatttgctgaatcatttcaaactggtgacagagttggggggagaagtggttcaggtgcagtcgagagatgtattgcagagcattgtacaggtttgcaaagaaaaacaaatatccactgtttgtatgggatcccctttcctccgattgcccggcgctgtgtgcggaatattgaaatatcgcagatttttaaataatctggcacaagcgaacgtagatttgattatacttgcataaaaaatgatttagtctcattatcgattatgaatataaaaaccaaattacttttcggcattggaatattggccggaatgatcattttactggtaacactttcagtggttaatcttcagattttgacggctacggaacctgacagtccggttgctatgcctgctctggaacgtgctcttttatggatttccataacgggtggtatttgtatcttgacggggttggttctgcttatttggctaccccgctccattaatagaccggtaaaggaactgactcgtggaattctggaaatagccaatcataattatgaaaagagattggatatgaaggggtatgaagaattcagggaggtttccgatagttttaatcgtatggcagagaaactgacagaatatcgtgacagtacgttagctgatattctttctgcaaaaaaatttcttgaggctgtagtcaatagtatccatgaaccgattatcgggctgaataccgaacgggaaattctttttattaataatgaagcactgaatgtgctcaatatgaagcgtgagaatgtgattagacactcggctgaggaactttctttgaagaatgatctgctgcgcagactgatacgtgaactggtgactcccggcgaaaagaatgaacccttgaaaatctatgcggataataaagaaagttatttccaggcttcttatatcccgattgagaatgcagaggcagaaaaaggagaagcccgtaatttgggagacgtcattttgctgaaaaatatcacagaatttaaggaactcgattcggcaaaaacaaccttcatttccactatttctcacgaactgaagacccccatttctgccattatgatgagccttcagctattggaagacaagagggtaggagttctgaatggagaacaagaacagctgtcaaagaatataaaggataacagccaacgtttgcttgatattaccggagaattactgaatatgactcaggtggaagccggtaaacttcagatgatgccgaaaattacaaaacctatcgaactgattgaatatgccattaaggccaatcaggtacaggccgataaattcaatatacagatagaagtggagtaccctgaagagaagatacctaagttatttgtggatagtgaaaagatagcttgggtgcttactaatcttttgagcaatgcaatccgctattctaaagagaatggacgggtggtgattggtgcacggcgtgaagaggagtatatcgaactctatgtccaggactttgggaagggtattgatccgcgatatcaccaaagtatttttgatcgttatttccgtgtgccgggcaccaaggtgcaggggagtggtttaggattgtctatctcaaaagactttgtagaagcacatggaggtacgttgaccgtgcagagcgaattgggtaaggggagctgcttcgtgatgagactgaaggcttgatgatgattgtaaatgacagaggtgaacttgtggctctgtagggcattttccggaaaaaacaacttataacatctttatattaagctttttttgttatttttgtcagcgtattgatatataatctgatacttgtctaagttaatcttttaagcgaggtataataatgcattctgaaatcgcagatgaaaaattgctggtcgtccaattttcacaaggaaaccatatagcgtttaagacactgtttgtgcgttattatccaaaagtgcgctcttttattatgggattggttaaatcagagagtgaaacggaagatttggcacaagaggtttttcttaagctgtggacccatcgggaacgatttcgtgaagtggaagtctttggtacttatctgtatgttttgactaaaaatacaactttcaattatttgcgttccaggcagaatcgtcaggatgatcaaagggctgattcagtggaagagtctacggatactacaccttacgaagagttagttgccaaagatttgcaattattgattgatatggtggtagagaacatgcctcctcaacggcaaacgattttccggttaaaccgggaggctgggcttaccaatgcagaaatagcggaaaagttgcagataagtaaaaaaacagttgagaaccatcttaacttggcattgaaagaactgaaaaatgctttgttactctttatttttctctatttatgttaatacggttagggataaactcggatttatacgtcctattataaattactaatagaatgagttatttaaaaaatataatcacttactttttccatcatccggcatcggaagaggtggcggggagagtgtataaacgattaaccgacacaaacagcaagcaagagaaagaggaggctttgtctggtatttgggaacagatcggtttcccggaaggggatgaacacgaaacattaagagcgtttgagaagctggaacaacagattggaggaagctctgtgaagttggaagcggactctccgcgtttccgtattccccggtggacttgggttgctgcatctatcatcatccctctattgcttttattcggttctgcttatttatatacagaaactcttactatcaagaatgaactcagtaatgtgaccttcatccaatactatgttaataatgggaagagggaacaaattatcttacccgatcaatcgaaagtttggctcaattccggttctctgttggtttatccatcttcgttcattggagatgaacgtgaagtttatctggccggtgaaggttatttctcagtaacgaaaaataaagaatgtcctttcattgtgaaaacgaactctatttcaatcagtgtactcggtacggagttcaatataaatgcttatcctaatatcgataaggtcgtgacaactttggaagaaggatccattcgtatgttgctgaatcgttccaattcatcctatttactggagcctgatgatcaaatcgtttatatcccgtctaccggacatatagagcgaaaacgggtaaaagcttctgattattctgactggagagatggaggtttgtattttagtagtagtccgtttaaagaagtgatgcagaccttagaacgcgcctattcggttcaggtacatttacagacttctatttatcaatccaataatctgactattcatttttatcctaatgagtcgatagaaaatgtaatgacgctgatcaaagaaatgattccgggacttgaatatcagatagaggggaaagatatttatatcgaataagattttaaatattagcttttgttaaccttttgtcgttgggtgtagttaaataacagactgtcctattgtaaaagtcgccaaaggacggctattgtttaactaaaaaaaataatattatgaacaaaaatcggtcaatccgagtggcaaccttttgccttggtttgatgttggcgggttctctgcaagtacatgcccagaaagttacgtttcgggatggaacagtatcattgaaacaagcgtttgagaagatcgaagcatcttcgaagtataaaatcgcttataatgattcacacctgaacgtctcccgtaaggtttcgttaaaccagaaagaaactgaagtcttggagatattggcaaccatcctgaaagatacgggttatacatacaaaaagaacggcaactacatcgttattgtgccggtggagcaaaagcctgcttcaaaggtaaagaaagtgaaaggagttgtaaaagatgccagtggcgaggcgattatcggagcaaatgtattagtaaaaggtacgacaacaggagtaattaccaatctcaatggagattttgagttagaagtgccggataacgcagtattacaggttacatatattggatatgtacagcaggatatagctgtaaaaaaccggaatcaattaactatctcgctgaaggaagatactaaaactttagatgaagttgttgtcgtaggttatggtactatgaagaaaaaggacctgaccggagctgtagcatcagtgaagatggatgatactcccttaagtacaatctctacggtaagtcatgcattggcaggtaaggctgctggattgcaagtaaacacagttagtgcccagccgggtgggggtacaacatttcgtattcgtggagctgcttcgaccggtgcaggtaatgatccgttaattattgtggatggatttcctgtaagtaatgcgggaaatgtcagtgtcggttataacagcgataatggtacaactgataatatattggcctctattaatcccaatgatatagaatcaattgaagtattgaaagatgccagttctactgccatttatggtgcgcgcgcaggtagtggtgttatcattattacgactaaacggggaaaagaggggaaacccaaagttacctattcaggatcggctactgtacagaccatggctacccaatatgaaatgttggatgcacaggattttatgattcagtctaaccgctggttcaaggaaaaatggatgtatgacaataaagttggtatttatggcggtaagagtgaatcggatgtcgccagtgcatatagtccaaaatattcggatgcggagattgcgaatccggtgaacgatacggattggtttgatcacattacgcgtaccggttttcagacacagcataatatttctatcaatggaggtacagaatataccaaatatctgatttcgggtaacttttttaatcagaagggtattgtgaagaataatggtatgtcgcgttataccggacgtgttaatttggatcagaaacttagtaaatatgcaaaagtcggtatcaacctgactgtgagccgtaatacattggacaatgttccgttgggagcggggcaaaatgaatatgccagtattttagtgtcggcagctcagtttagtcctctactttcggtcaaagatgaaaatggtgattacagtttgaatcaacaagctgcttatattccaaaccctgtttcattacttgagattagtgaccaaacgactaaagaacgtttgttggctactccgtttgttgaaattaaacctattaatgaactcacattaaaagcgagcttcggcattgaccgcaactaccagcgtcgtgaagtctatatgcccaaaacaactctttatggagaaaaggcagatggacgtgcagatatcgggcaatatgacagatctgattatttgctggaactgacagccaattatgcaaagcgttttggtaaccataatttgaatgctttggttggatattctttccagcgtttcaccagcaaatatctgaatgccggtaaccaggggtttttgacggatgcttttctgtttaataatctgggtgcaggtacttatgagaaaccatgggttggttcttccgcttctaaaagcgaaatggcttctttcttcggtcgtgtaaattatacctataaagatcgttatttgctgactgccactcttcgtgctgatggtgcctctaactttgcaaaaaataaccgctggggatatttcccttctgtcgctttgggttggagatttacggaggaaaattttgcccggtctttgaatttggataaagtgctatctaacggtaagttaaggttaagttacggacaaacaggtaactcgaatattggagataaatcagtcacttattatggtactggatataataaagttttcggtaataaagaatatacaggagtttatgtcagtcagatcggtaatccggatttaaaatgggagacgacgaccgagtggaatgtaggattggatctgggcttcttaaacaaccgttttaatgtaacggcagaatactttcataaggtagtttctgatttgcttagttcccgcagtgtgctttcatataatgaagtaggttcaattgcagccaatattggtaaaacacaaagccaaggatttgaactgacagtcaatacaaagaactttgatacaaaagattttagctggaataccgatttcactttctcattctatcgtgataaatggaaagaacgtgacgagagctggagcccgaacccatacgatatgtataatgctccgttgaggggatactatatgtatctgtctgacgggttgattcagccgggagaggaagtatcctggatgccgggagccctaccgggacaggtgaaattaaaagatattgatggatatgcttacaatgcagacggaacttataaaaccgataaacatggcattccattaaggactggaaagccggatggaaagatcgattatgcggatgctgtatttaaaggttgcagtgatccggggtatttgttgggattgaataatactttccgttataagaatttcgatctgaatgtttacttctatgggcagctggatttattaaagagtggttcttataaagattattggattgttggttcagggacaatgactggagtgaataacttatatcgtggctataacatgccgacttcggctaaagatgtgtggtcacatgataatacatcgggtaagatgccgggttattttcaatatatgagtaattatggatatggagactattttctggaaaagagctggtttattcgatgccgtaatattacattgggatatacattgcctgttaaatcggcaaagaagctgatttccaatgtacgtatctacgctgatgtaaacaacttgtttactattactccgtatgatggtttggatgtggaaacggatgattcttattgggcatatcctaatgtgcgcagttttagtattggtctggatattactttctaagcaataaaaaataaagaatgatatgaaaaagataatttatatattttccctgtttatcgcagtgattggtttattggattcttgcattaacctggaatccgaatcatacgactctattaatacaactatatttccaactaatgcagatgatgcagatgcactggttattgcagcagcttacggtccgttccgtgcagatggatatggcggattatttcaatgcgctaaaggtggtctggcctccaatacagatatgtctaccgacctattggattgtaaatggggagattcatggtggccggctgtattacagttgaatttcactgctacctctgatatccctacttctttttatggtacgtgggcgaatcatatcggaaagatgacattgacattagaccgtatttctggtattgatatgaaagaagaggaaaaaacacgtttagttgccgaaacacgttgtggacgtggctggttagcatatattctttacgacttgtatggccctattcagattccttcattagaagttttacagaatcctacccagaaggtcattgtacctcgttcttcaaaagaggaaacagtgaagttgattgaagatgatttgaaagcggcagctgaagtacttcctgctaaatatagcaagtctgatgagaacttcggacgatttaccaaaggactggcatatacagtgttgatgaaactttatatgcatgaaaaagaatggggcaaagctgtggaatgtggaagagaagttatgaaatgtgggtattcgttggttgctaattataaggacatctttactttagagaatgaaggcaatgatgaaatgatcttttcatgtattgaaaccagaggggtaaatgagcaaatgtggcatgcacatgtgttgccaagtaattatcctacaactaatccgaatatccaaaaatggaatggttatcgtatgccatggcagttttaccacagtttcgaccctaaggacaagcgtctggaagttatttgtagtgaatatgtaggaacagatggggtgacatacaatgaaactaatccgggcgagtatctggataaaggtgcattgcccatcaagtatggagaagatccgacacagactagtgaaagcagtgaagtagatgttgttgtttaccgttatgccgatgtattgactctgatggctgaggctttggcacgtagtaataatgcagttactcaggaagctgtggaccgtctgaatgatgtacatacacgtgcaggattgactgcttatcagttgagtgattttacctcactggacgattttcttggagctgttcttaaagaacgtgggcatgaattatggggtgagggctgccgtcgtagtgatctcattcgttatggattgtatattgattatgctatcaagtataagggatctactactgcaaaagagtatatgaacctgatgccgttgccgcagagtgtcattaccgaaagtagtggacaggtcattcagaatgagggttactaatgcttattaagagattattataaatttattcaaaacggattccgcaatttgtcatggggcatcttatgattctttaaattgccgggatccgttttttcacaattagaatagaaaaaacagattatgctttttaaaggaatacgtttagccgttttattatccggaatgttgattttcagtccaatgactccggcacaaattgttttgaaacaccctggttgggaatggagaatttctgaaaccggatgtgcggaacaactaatatttaaaaataaacaacgaaatgatacagtaccttttttccgtaagggcgatcatgccggcccctctttctatgctaaacgcgagggaaaagagatacgtgcgccttggattccggatggatatgcttcctatcgcagcgaaatagacggggtgctttgctgcatttcctatacaaaagttcatgggcaacctgcattgagggtaaagttgactaacgagtcaccagttccttttcaacctcagaaggcagggcttaagttaggtatcgatacatatatggacaaatatccggattggttcggtaaatattttccaactttgatgagaaatgaaaagactcatttttacgggtatctgcagactccttccggacatacattgggacttgtgtcacaacagcctgtagcatcttggagtgtggactataatttgggatatcaggatccggcaccgttttggttcatggggcatcgcattgaatcgctaaatcttgacttgttgaatgctttacctttaccgtctcgtcatccgcaagatttgtatgagttgaaacaaggcgaaagtaaagagtggaccttcctgttcatcaatgtggggaagctggataatttggaatatgctataacacaagctgcagatattcctttgattgatattcgtcagacctcttatgctgcgcatgaggaagcgtcattcatgcttacagcggatactccagaggtaaaagtaactaatgatgcgggggcagagttacctgttgtgctgactaaagcggagggtaaacgttggataggaaaggttaaactgggagatgcaggactttatactctttccgtccgttcgggcaataaggttgccgaagcagtatggacggtgcatcatccttggcagtgggtgatgaaaaaggcacgtgagaatgtagcccgttatcatcagaaacccacatcacatgccgaaagttggtatgggttctattcggcctttctggccgcccgttattttccggataaaacattggataaacaattgagtgattattttgatcagctctacaataaattgcatgatccggaaaaagtggagccattgtattttaaaactcgtattcaaaatacttctactacaattgggatgttggcagataagtatgaggcacagggaaatttggaggatctgaagaaagcatcgaaattggctgactggatgattcggacttctcagcgtgatgacggagcctattataatcacggaacagtctataccagtgttatttatattgctaaaagtgttttagaacttgccgttcttgaacgtaaactgggtgagcaagatccgttttggaaagattgtgccgaacgtcattttttatctgccaaaaaggcaatcgaccaattggttgcatcacaaggtgatttccagacagagggagagctgacatttgaggatggaatgatttcttgttcggctttacagatcggtatgatgggggttcttgaaaaagatgctgaaacacgtaaatattatactgatgcaatgctgaagattcttaatagtcacgattgtctgactcagcttcgtgttcctgatggacgtcgccggcaaggtactatgcgttattgggaagcgcaatacgatgtgcaaatgttaccgaatatgtttaattcgccacatggttggagcggatggcgtgcatatgctacctattatgcctatttgttgacaggtgacgaaaaatggttggaacagacatttaatgcaatgggggcctttgctaatttgattgattataagacaggacagttgcgttgggcttttgttgttgatccacaccttgaagtagagcaggcatgcagtgctgatacaaaattgaacttttcagatcttagttttggcaatccgcatcccaaattatatgatacccgtaagtttgttattggcgaacaatatgtaaacatgatcagcgattggcagacagtcaatactcaggataatgatgtgcacgaactgtttaagtgtattggtgagacggtactgactaatgcttttgtgatagaacgtccaaatggtgaggtggttggatataattgtcgtgtatccggaaaaggtaatacactgacagtaaaggcagatgaaaaacaaatcgtgaatctgcattgtaacttgaaacaaccgttctctgtgacttttggtggcaaatcccgctctttacccaaaggatactgtgattgggcctttgggcaatccggttattaattattcgataactttcattgatcccctgtattcataaaacgagatgtgtgatatgtttcgttttatgaatataggggatgttttttgaagaaactgtttttatgagaaactttggcttactcataggaatacttatctttgcatagaatgaaataacactaacagaaacacaaaatgagacatttatttttattggcagtgcttttgtatgcctgcacttcttacgcacagattcatgtgcaagagcgactttcggagggggagaccagctttgttttgactactcctgagttacaagccaaaatttattatgatgtaaatgatgaacttgtcatcaaaaaatcggcagagttatttgcttttgacgttgaaagagtgaccggccgaaagcctgagttaatccaaaagcgtgaaagagcgaacttcctggttattgtcggaactattgaaaagaataaatggattcaggagttggcgcaaaaggggaaaatcgatatacgcccgttgcaaggggcttgggaacgatatctgattcaaacgatcgacaaaccttatccgggggtggataaagccctggtcatagccgggagtgatcggaggggagctgcttatggtttgttttccatctccgagatgataggggtgtctccttggtattggtgggccgatgttccaataaaaaagcatgaagcactgtatattgatgctccggccacttactctaaaactccttcggtgaaatatagaggtattttcttgaatgatgaagactgggggttgaagccctgggcagctaaaacctttgaggaagaacgtggtaatataggtccccgtacctacgcgaagatttgcgagttgttgctgcgtttgaaagctaaccacctggctccagccatgcatcctgtatccacggcattttaccggattcctgagaataaactggtagccgatacattcgccattgtcatggggtccagtcattgtgaacctctattgttaaatacagccagtgagtggcatagtgagacgatggggccgtgggattataacgctaacaagaataagattaacgaaatattaagcaatcgtgtgaaggaaatttgcacttacgagaatgtatatacattagctttaaggggattacatgacgccgccatgggaggtggcaatgtgccgatgaaagagaaggtaaagatgctggagagtgcattgaaggatcagcggaatctgatagcccaacatattaataagcctgtcgaaaccattccccaggcatttactccctataaagaggtattggatatttattcgaatggtctggagctgccggaagatgtcactattatttgggcagatgataactttggttacatgaaacggctgagtggtccgcaggaacaaaagcgtgcgggacgtgcgggggtatattatcacctttcctaccttggagtaccccatagctatttatggtttagcaccactcctccggcattgatgtatgaagaacttcgcaaagcgtatgatactacagctgattgtatttggttggcgaattgcggagacctgaaaggttccgaggtacaagtttcgttttttctcgatatggcttatgatattgagcagttcaacgaaaaaaatgtgcatacctatcctgcccgttggttggcaaagatgtttggagaacaatattacaatacgttggaggatattacctgttcgcatataaacctggctttttccagaaaacctgaatatatgggttggggatattggaataattattggggtggaggagaaaaacgtactgatacagaattttcttttacgaattatgaagaggctgggaaacgtctggcagagtaccggcgtatcggtaaaaaggcagaagatatgctggttacattagaagaggcggccagacccgcactgtaccaactgctgtattatccggtaaaaggcgctgaattgatgaatcgaatgaatatgacagggcaactgtaccgacagtatgtgcgtcagaaacgtgccgctgccaataatctgaaaagagaagtagaatgttgtcacgatagtttagaggttattaccgataggtataattctctcttgaatggtaagtggaaatacatgatgtctctaagacaaaattatgatggaagtagttcttattttatgcttcccttgatggaggaatgctatatgccggcaggtgatccgaaattagctgttcaggccgaaagcgaacaactggaccggggaggtttcagttgtcatgttttacctacgttcaacacgtattcccgtaaaagtcactggatcgatatttataatcaaggaggtggaaaattggcttggaaatcggtagcctctgacgaatggattgttttgtcctgtcaatcgggcattacttttacagaggatcggatccgggtatctatcgactgggataaagtccccgtaggggagaaggtcacaggagggatagagttctcttccgggatgcagaaagagcgtgtgtttgtatctgtattcaatccgatggttccggcacgggatgagttacagggactttttgtggaagaaaatggttatgtatctctgcctgctactgactttcaccgtaaatttgagagtaatgacattaagatgcacatactgccaggattgggtttcgaaggctctgccttgcaaataggcagtccgacagctccgttacagatgtaccgatcgggtgaggtccccagggtagaatatgatttctatactttcaatgcagggatagttgatgtgtatacctatgtactaccaacttttcctttacatgctgagcgggattacaaactaccggagcataccaattcggatacaaaatacagtgtccgtattgacgatggctctatttccaccccatctacttcggccatagagtactcgcagatctggtatgatagtgtattgaagaattgcagggtgaacaaatcaaccctttatgtaaaagctcccggcaagcataccttgcagattcgttgtggagatcccggaacagtgattcagaaaatagtaattgatatgggcggtctcaaaagatcatatttgggacctgaaagtactctttgccattgatattatttttaattaacattcttggatgcaggcttttcggaattgttttatttctataaatagagagaacctattttgaatgtctaatgaaaatgaaatctattatgaaagtctgttcattcttgaataaaggagttataattgcgatggcggttgtttgttctgccggtttacagtcttgtctggatgacaatgataagtactattatgtaggaggatttcctaatgctcttgtaacagtgaaaaacgcgactgatggttcatgctttttacagttgaatgatagcacgacattattgcctactaatatgacctcttctccttttggcgagaaagaagtaagggcattggtgaattatgatgaattggatgaatcaggtggaaaatatgataaggccatacaggtgaactggatagatagtattctgaccaaatcgattgcacctgatcgggggacggaaaatgatgttgtatatggcacggatccagtcgaaattgtgaatgactgggtgactattgcagaagatggttatttgactctacgtttcagaacaacgtggggagactatcataaagcccatttcgtaaatttattgttaagccagaatccggagaatccttatgaggtagaattccgtcatcatgcgtacggagacacatatggtacgatgggagatggtctggtcgcttttaaactggatggtctgccggatacaaatggtaaaacagtcaaattaaaactaaaatggaaatcatttaccggcgacaaatctgcagagtttgattattgcactcaaaagtccgttacaccagttaatgcagcaatcacatcggtaaggagtaatttgaacttaaaataacttctcaagccccaaaaggttacgttcctgtgaatctcgattggagcatacggcttgccgggatctgaaaatagataggagcgtagcccttttctattaacattgttaatgcctttttcagaacgttttttttctatttgcagagaagaagtcttttgtgcacaaaagacttcttctttattatcaaaaggcttgttttaacgtactgttaaaacaagccttttgcaggaatgtaactaatgcttataattacttgatttttaatcttatggagtagtgtcagaacttttactccccaatattctcctataaggtttagcggggatatttgctattttaataagtatatgtgctttgataaaaaaagtaggtggttgaacctttcgataagattgtttgttcagacttcctgtatttacctcatttcagtaaatagacttacatagttgaaacattatcattttcccttgttgatagcctgtttgaagtaatggttaatagaatgaatgtaaacttgtaatcaattgaagcttattttgttatcctgttgataactttggtggatacctgttaataaccttgttgataactgagtggaatgtatgaggggagcagcgtgtcgggcaataaaaaagcgcccaagagtggaagcctcctaaacgctaattttcttttggtagcgggacccgggattgaaccggggacctcatgattatgaatcatgcgctctaaccagctgagctatcccgccattgtttctcgattgcgggtgcaaagatagagccttttttttaatctccaaaacattttctatcttttttgtgtttaacttaaaaaaacatctctgaaagtatgatgaacaggctatttctgactctgaaagaagagatgtaatgaagaaagtgaattaattatgccttgtatttagaaaaaagtatttatcttggcacacacaatcaataataaagctatgaaaaaggagaaaatacatttggaatatcttctgaatgcgacttctaaaaatattctttggtcagcaataagcacacctaccggtttggaggactggtttgcagacaaagtagtatcagatgataaaacagtgactttttgttggggtaaaaccgaacagcgtcaggcaactattgttgccattcgggcctattcgtttattcgtttccattggcttgatgacgaaaatgaaagggagtattttgaaataaaaatgagtaataatgaattgacgggcgattatgtgcttgaaattagtgacttttctgatccggaagaggttgatgatttgaaggaattgtgggattcccaagtgagtaagttacgtagaacatgcggtttttagttaactttcaaccaaaaattttttgcactcctttttttgtgctaattttgtatcttaattgcatgaaactattaagatgctacgcataaaaagattagatatttttataataaagagtttcttattactctttgtcggtacatttttcatctgcctcttcatcttcatgatgcagtttttgtggaagtatgtagacgaattggtgggaaaagggttagaaatgagtgtactggctcaattcttcttttattctgcgttgagtctggtaccgatgtctctgcctttggcagtgttgttggcttctttaattacgtttggtaattttggcgagcgttttgagctgctcgccatgaaggcagcaggcatttcgctgcttaaaattatgcgtccgctcattgtccttgtcttcgccatttgttgtgtatccttctatttccaaaatgtcatagggccgcgggcacaagccaagttgggcactttgctcatttcgatgaagcagaaatctcctgaggtagatattcccgaaggagttttttatgatgaaattgatgggtataatttgaaagtgcaaagaaaagaccgtaagacgggcatgctctacgatgtgattatttatgatttctccaataactttgataatgcacgtattattgtagccgattcgggacgtctggagatgacagccgataagcagcatctttatctacatctgtacagcggtgagatgtttgagaatctgaaggcacagagcatgagttcgaagaatgttccttatcgccgggaatctttccgggagaaacatacgatcattcagttcgattcggactttaatatggctgatgccagtattatgagcaatcagtctaccaccaaagatatgataaaaatacaggcttccatcgactcgatgactgtattggccgatagtatcggcaggcagtattacattgaagcaagtaaggggccgtatcgcactgcggccggactgaccaaggaagataccctgaagatggaggaagcgcgcattggcgattacaatgtggatagtctgtttaaagttgctaccttgatgaataagcagaagatcatagcttcagccgttggccgtacggagaatctgtcgagtgattgggggtttaagagctttacaatggctcagaatgatcttagcatacgaagacataaaatagaatggcatcggaaaatcacaatttctctttcctgtctcttatttttctttattggcgcacctttgggaggcattatccgcaaaggtggattgggtatgccggttattgtttccgtgtttacctttatcatttattatattattgataatacaggctataaaatggctcgcgacgggaagtggattgtatggatggggatgtggatgagttccgccattctggctccgctgggatatttcctgacttataaatcgaataaagattctgtggtattgaatactgatgtttatattgcttggtttaagcgagtattcggtgtgcgcagtgtccgccatctgtcaaagaaggaggtgattattcatgatccggattatcggcgtcttccctctgatctggatgcactttcggaggagtgtaaaaactatatggaaaagaaccggttgtctaaagctcctaattattttagtttgtggatgactgccggtcaggatcaggagatcattgcgattaacaaccgcatggagtcattggtagatgagatgtccaatacccgttcgttgatattgcttcagaagctggagaaatatccgattatccctgtaaacgcacatgtgcgtccgttccataattattggcttaatatggcaattggaattttgatgcctatcggtttatttttctatttccgtatctgggctttccgtatacgcctgaataaggatatggaacggataattgcattgaaccgggatgtagaacttacaataaaggatattaataacaaaaattaagatataagagtatggaaccaataagactgaataccatcgaagaggcgatagccgacttcaaagagggtaatttcgtaattgtggtagatgatgaagatcgtgaaaacgaaggtgatttcattattgctgccgaaaagattactccggaaaaagtgaatttcatgctgactcatggccgtggcgtactttgtgctcctataacggaagaacgctgtgccgagttggaactggatatgcaggtgtcatccaatacttcaatttacgagactccctttacggttactgtcgatttacttgagggatgcacgacgggagtttccatgcacgaccgtgctatgactatccgtgctttggccgatccgaagacaaaaccttccgatttgggacgtccggggcatgtcaatcctctgcgtgcccgttcgcgtggagtccttcgtcgcgctggacatactgaggcgagtgtcgatttggctaaacttgccggtttgtatcctgctgccgcgttgattgaaatcatcaatgaagacggaaccatggctcgtctgccccaattggtggaagtggcccgtcgtttcggattgaaaataatctccatcaaagacctgatcgcataccgtcttcagatggagtcgattgttgatagaggagtggaagtggatatgcctacgcagttcggacatttccgtctgatacctttccgtcagaaatcgaacgggatggagcacattgcattaataaaaggaacgtgggacaaagacgaaccgattctggtacgtgtgcactcttcgtgtatgactggtgatattttcggttcatgccgttgtgaatgtggtgagcagcttcataaagctatgcagatgatcgaagctgccggaaaaggggtaattgtctatatgaatcaggaaggtcgtggtatcggtttgatgaacaagattgccgcttataaactccaggaagaaggatatgatacggtagatgccaatctccatttgggttttgatgctgacgaacgtgattatggggtcggtgcgcagattctgcgtgagatcggagtgaaaaagatgaagttgatgacgaataatccggtgaaacgtatcggtctggaagcctatgggttagagattaccgagaacgtgggaatagaggttaaaccgaacccttataatgtacgttatctgaagacaaagaaagagcggatggggcatacgcttcattttaataagtaaactgtctatttgctttcatatatcaaatattatagtttattttgcaatcaaattcactcaacaacaataaaatagatacgaaatgaaccaactatcagaccgtttgaacagcttgtcgccttcggcgactcttgctatgtcgcaaaaaagcgctgagctgaaagctcagggtgttgatgtaattaacctcagtgtgggagaacccgatttcaatactcccgatcacatcaaagaagctgccaagaaagcggtagatgacaacttctctcgttactctccggttccgggctacccggctttgcgcaatgcaatcgtagagaaactgaagaaagaaaacggtctggaatatacagccgctcagatttcttgtgcaaatggtgcaaaacaatctgtatgtaacaccatcatggtgttggtaaatccgggtgatgaggtgattgtgcctgctccttactgggtaagctatccggaaatggtgaaactggccgaaggtactccggtgattgttactgccggtatcgaacaggatttcaaaatcactcctgcccaactggaagctgccatcactccgaagaccaaagctttgattctctgctcaccgtctaatccgaccggttctgtctacagcaaagaagagttggccggtctggcagccgtattggctaagtatccgcaggttatcgtcattgccgacgagatttatgagcacatcaattatatcggaaaacaccagagtatcgctcagttccccgagatgaaagaacgtacggtgattgtaaacggtgtgtcaaaagcatatgcgatgaccggatggagaattggtttcattgccggtccggaatggattgtgaaagcctgcaataaacttcagggacagtatacttcgggtccttgctcagtttctcagaaggctgctgaggctgcttatacaggttctcaggctccggtggaagagatgcgtaaggctttcgaacgtcgtcgtaacctgattgtgaagttggcgaaagaagttccgggatttgaggtgaatgtgccggaaggcgctttctacctgttccctaaatgcagttctttctttggcaaatccgttggggatcgtaagattgagaattcggatgatttggcgatgtatctgcttgaggatgctcatgtagcttgcgtaggcggtacttcgttcggtgctccggaatgcatccgtatgagctatgccaccagcgatgaaaatatagttgaagcgatccgtcgcatcaaagaagcattggctaagctgaaataagactctgccaatcagataaaggagaaggatgtatcggtgaaaagatgcatccttctttctttttaagagtatccggtttcaatacccgggtaggggtaaaaatcaataaaggccgctttccatcaggaaagcagcctttatcttgttttgggggattgtattattcagctgggtgaattgcttcagaaggacatacatctgcgcaagtaccacagtctgtacactgctcaggatcaattgaataaatatcaccttcagagatagcgccaaccggacactcgtcaatacaagttccgcaagcaatacaatcatcactaattacgtaagccattttgtttgatattttaattattagtactaatttgtaggtacaaaaatagagtttttaatcattagttggtatcgattttgattaaaatgttttaatttgtatatcttctaaataaggaaaacactatttttgcattgattattaaatacgtatgcaattatgcctttaaatttacccgataagcttcctgcgatagaactattgaaagaggagaatatctttgtgatagataactcccgcgcaacacaacaggacatccgcccgctacgcattgtcatcctcaacctgatgccgttgaagattacgacagaaacagacttggtgcgtctgctctcgaacactccgcttcaggtggagatatcttttatgaagataaagagccacacttcgaagaacacgccgatagaacacatgaagacattttataccgacttcgacaagatgagggacgataagtacgacggtatgatcattaccggtgcgccggtagagcagatggatttcgaggaggtgaattattggaacgaaataacggagatatttgactgggcacgtacccatgtcacctctacgctctatatatgctgggccgcgcaggccggtctgtaccatcattacggtgtgcccaagtatgcactgggcaagaagatgttcggcattttcaaacatcgcacgttgcttccgttgcatcccatcttccgcgggttcgatgatgaattttatgttccccatagccggcatacggaagtgcggaaagaagatatactaaaggtgcctgaactgacattgctttcggagtcagacgattcgggagtgtatatggtggtggctcgcggtgggcgtgagttctttgtgacggggcactcggaatattcgccgttgacactggatacggaataccgccgggatgtgtcgaaaggtctgcctatcgaggttcctcgcaattattatgtagatgatgatccggacaaggggccgctggtgcgttggcgcggacatgccaacctgttgttctccaactggctgaactatttcgtctatcaggagactccttataatattgaagatatcagatgataaaacaacgtaagatagaattgctggctccggccaaaaacctggaatgcggcatggctgccatcgatcatggggcggatgccgtatatatcggtgcgccgaagttcggtgcccgtgcggcagcggtcaattcattggaagatatagccgctttggtggagtatgcccatttgtataatgtgcggatttatgttacggtcaatacgatcctgaaagatgaagaactgaaggagacggaggagatgatccgggccctgtaccgtgtcggagtggatgcgcttattgtgcaggatatgggaatcgccggtctggagctgccgcccattccgttgcatgcgagcacgcagatggataaccgtacggcagagaaagtgagatttctggccgatgcgggcttccgccaagtggtgttggcgcgtgaactttcgttacgggagatcggcaagatacacgaggcttgtcccgacgtgcctctggaaatctttgtgcacggagcgctctgtgtaagttatagcgggcagtgctacgtcagccaggcttgtttcgggcgtagtgccaaccggggtgagtgtgcccagttctgtcgtttgccgttcagcctggtcgattcgaacgaccgggtgatcgtgaaggacaaacatcttctttcactcaaggatctcaaccaaagtgaggagctggaggctctgctcgatgccggtgcctcttctttcaagatagaaggccggttgaaggacgtttcgtatgtaaagaacgtgacggccgcctaccgccagaagctggatgccatccttgcccgccgcaaggagtatgtgcgtgcttcttccggcagctgccgttatgctttcaatcctcagctggacaagagtttcagccgtggttttacgcattatttcctgcacgggcgcaccagggatgttttttcgttcgacacccccaagtcgttaggagaggagatggggacgatgaaagaggccagggggaattatctgaccgtggcgggattgaagtcgttcaataacggtgacggtgtttgctacattgacgagcaaggcaaactgcaaggtttccgcatcaaccgtgtggagggcaataagctctatccgcaggagatgccccgcatcaagccccgaacggtgttgtaccgtaacttcgatcaggagtttgagaagatactcgcccgccggtcgtccgaacgcaagatggccgtggccatccggctggcggacactgccttcggattcgccctgacgctgacggatgaggatgataatcgtgtgaccctgtcgctgccgcgtgcgaaagagccggcacgtacgccacaggaagagaacctgaagacgcagctggctaagttggggaatactcctttcgaagcggaacgtgtcgacatcgacttcacggagaactggtttctgcctgcttcggtattggccgatttccgccggcaggcgattgagaaactgattgccgcccgccgtatcaactaccggagagagctggcggtgcttaggcctacgactcatgcttttccgcagacgacgttgacctatctgggaaatgtgatgaatgcgcgggctgcctctttttatgccgggcatggcgtggcaagcattgctcctgcttttgaacagacgcctgtggagaaggcggtgctgatgttctgcaaacattgcctgcgctacagcatgggctggtgtccggttcatcaacgggaacgctctccgtatcgtgaaccctattatctggtatcgacggacggcaaacgcttccgcctggaatttgactgccggaactgccagatgaaagtgagtgccttatgaaaatgaaggggctctgcgcgcgtctgtgttgtgccgtgataggctttttcctgctggcggcctgccattattcaccgcccgatctcactgccgaggggctgggggagaaaacaaaggactctttagcttatcttttccggtaccattatacctggaacacgaatctggaggtgctggacgactccgtccggttggaatatcttccggtgaaggatgcctatgtcagtctgaacaaaggtgaccgggtggtcgtggcagagttctccattcatccgcaggacagcgtggacagcgtatgggtgaagctggcccactcgcaggacgtccaggggtgggtgcgcaaccgtgatctggtgcgctccttcgtgcccaccgatagtatttcgcagtttatccaccttttcagcaatactcacgcttcgtatttcgtcatcattttcgccctctttgtcggggcctacctgctccgtgctttcatgaagaagcagttgcagatggtttacttcaatgatatcgacagcgtctatccccttttcctctgtctgctgatggcgttcagtgctacggtttacgagacgatgcaggtgtttgtccccgatacctgggagcatttctactttaatcccaccctttcgccgttcaaggtgcctttcatcctttcggtttttctgctgagcatctggttgtttattgtcgtcacgctggccgtgctcgacgatttgttccgccaactcactcctgccgccgccgttttctatttgctggggctgatgtcttgctgcatcttctgctacttcttcttcatcctgaccacgcacatttatatcggttacctgtttttagcttgcttcatctggctttttgtgaagaaggtgcgtaggaattccggctataaataccggtgcggaaactgtgggcagaaactccgggagaagggggtatgcccgcattgcggggcgatcaacgaataagatcttctcaccacagaggacacagagggcacagagttttaattccgctcgcccttggagggtggaggacagagaaaagagagagaaaaaaactactctgtgtcctctgtgtcctctgtggtgagaacagtgaaaactacggtgcaccgttgtttccgcccccttcggggtccttccggaggcgcaggcttcggcgtcagaaccggcagcgcacgtctaccccgaagtgcaccggacggcctttttgcatgaatccgttgcccattgattcgaaatagaacgcggcatattccttatccagtatgttgcgtacccagaatccgatctgtccgtttcccttctccaggctgacacgtccgttcagggttccgtagaacgactggctgacgttgttctgctccgtccagtagatccgtccgacaccgttgtagttcaagttcacctgtacccggtccagccagtggcggggagcgatgcggaagatgtattgcgcgcccacgttgagcgtgtgtttggggacgaaaggcacgtagttgccgttatagttttctttttcttgcaggctgccgtcctccgttttctggcggacgacgtaatcggtgaacgtggcatacgtatatccgtagttagcgttcaggctgagcgcgtctgtcaggctgctgcgcagggcgacttcggcgccataacttcggctcttgccggcattgatggtgatgcgtcccagtccgctttcggcaaactgcgctatctgctggtcgcgcgtatccatataataggcggcgaggtcggcccagagacggccttcccacagggtgaggtgcgcgccagcttcgtagttccacgagtattcgggcttatacgtggtcgatgccttcacgtcgatcttctcttccggcatcatctggccgatcatcccggcgtatttcttgaacacgtcgctttccatcatggcggttttcatcgagttcttcagttcgctctgcaccaggtcggagaacatctgcacgttgtatcctcccgaacgatagccgcgtgaaaccgtggcatagacgctgttccctttttgccattcatattgcagggcgaatttggggagcaattgcaggtaatcgttcttcagcttgcctttgaaggatgccggggccttcatgtgctggtccttcaggttcagcatgggcggcatgctgatgctgaaatcaaagtccatcgggtcgctgacggagttgtacgtcatcgatatcttttcatagtccaggcgcaggccggcggtaaaggagagcccttcggtgaagaggttgttgaatgtagactggtggtagatcgctccgctcagtatcggagtgtcaaagttgccgctgacgcggagtgtcgggttgttcaccgtcagcgccatccggggggctttgggccctaagttggcgaaggccttgttggcgttgccctctatcacctcttttaccccgtcttctttaaatatcaccggtccgtccgtgttcagccactgatagaaaccgaaggcgcccgtagtccattgccagttgcttcccggtttcgatttcagcatcacttcctccgagagggtgttcagcttctgcttctgaatcaggttgaacaggttcttctccgtgaagtcctggtcgagaaacatgcggtcgttcaggttctggaatccggttacggcgctcaggatgaacttctgcgcctggtattctatgttgactcccgcattcagcagcccgcggcggtaggtgctctcatcgttgtacgagatcttgccgattcgttcttttcgcggatcgtcctctctttccgccgggtccactcttcctgtgtagaagtacggatatcccccttcgtggctgtactcgtagctgatgttcaggtccagcttcaggttctcgccgggcaggtaaatgccgcggaaccgtccgcctgctgcctgactcttgtctattcttttgttaaggtaggtattcttgaaaaatccgccgccgtattcgtagaatccgcccgttgaaaaagcgaattgatccgatacacgatggtagtgggtcaccgaagcgttgtaattgttgtaacttccggcacccagacggaggtcggtgccctgatagctgaaaggcgatttggtgtgcaccttgatcagtccgcccatggtgttgcgtccgtagagggtcccctgaggaccgcgcagcacgtcgatgcgttcgatgtccgcgtagttgaagtcgaacgccgatttgtcgatataaggtacgttgtccacatacaaccccacggaaggcgtgttgatgcgtgagccgattccgcggatatagatggcggaagtcagcctggaaccatagtccggtatgaagatattcggcacaagggcagtcaggcttttgatggaatttacctggttggcctgcatatcctgctgcgagagcatggtgaccgcggtcggcagctcccgtagtttgcggttttctttcggagcggcgatgactacgatttcttctacgtctatcaccttcagtgtgtccttcggcagctccccggcccatgttccgctggccgaaaagagggcaagagcaataagaatgctgtttttcttcatttactgtatcttttcattgattcgtttgcaaagatgcagcaaaaaatgttaaacggcaatcctcatttattaggatatatcggattcaccacagaggacacagagggcacagagtaaggtatatagtgaatatagggtagtgtatatagggtacacagagcggacagcgcccacagcgcaatcgataactcaaaatatcctctgtgccctctgtgtcctctgtggtgaaaagcaggcttatatcctgtccgcctccacgtatccgttcatcaccgcgtagatggtcagtccggagaccgacttgatgcctaacttctcggtgatgttcttccggtgtgtgatcaccgtagtcaggctgatattcagcttgtcggcgatttctttgttgatcagccctttggtgatcagcaccagcacctcgatctcgcgtgccgagagctcgtgtccggtggcggcaggcgaggcaggaggcatgtctttcaccggataaccgtcgtggtgcgcgtgctggtggagtttcaggatatccttcaccaacccctcttccgtctggtagatgttgagtatcgggacgcccgaaagctggaattggtgactgtctcccgccagtacgatggttttccgtttccgggggaggaagaaagcattatgctccacatagatctgtgcggagatgaagtaatgagcgtacatgtccggtgtgtcgtccatcagttcgccgaaaccgggaaacgtgcggatgactgccatggggatcatcctctccaggattgttttcagtcccaggctggtgagggtgttcgcctctacgatggctatttcgggttggtgattcatcataagtcctattgattcataaattgtgctactgcttctgcgcatcgttctccatcgattcctgccgagacgatgccccccgcataaccggccccctcaccgcacgggaagagtccgcgcagggtgatgtgttgcaatgtatccttgtcccgcacgatgcgtaccggcgatgaagtccgtgtctctacgcctatcattaccgcctcgttggtgaggaatccgtggctgctgcgtccgaactgctggaagccctgtgacagccggccggtgatgaactccggcatccagaaatgcagcggagaagagataagccccgggctgtacgacgattccggcaagtcgtaactcagcttcctgcgtgtgaagtctgccatgcgctgggcgggagccgtctgtcgtctgcctccttgcagccagcactggcgctccagctcttcctgaaagcgcagcaccgccagctcgggatggctcccttctgcttcatcgttcgtcgttaaccgttcgtcgttcatgatgtcttccggctgtatctccaccaccatgcccgagttgctccaccgggagccacggttggagggcgacattccattgaccaccacctgctccggcccgctggcggcaggtacgataaatcctcccggacacatgcagaagctgtataccccccggccttccacctgtgtgacgaaactgtattcggctgccggcaggtattgccctctcccgttccggttgtggtattggatctggtctatcagtcctgccggatgttccaggcgtaccccgacggcaatgcctttcgcctcgatgggcaccttgttggccgccagccatcggtatacatcccgtgccgagtgccctgtcgccagaatgacgggtccgaggaatgtcttgcccgtctgggtttcaatgcctttcacctcccccttctcgatgatcagtgcgtccatccgggtttcgaagtgcacctcaccgccacattcgataatcgtatgacgcatgttctctatcacccgtggcagtttatccgtaccgatgtgcggatgggcgtccaccaggatggcggtggaagccccgtgctggcaaaatacgttcagtatcttgtccacgtttccccgctttttgctccgggtatatagtttcccgtccgagtaagcgcctgctcccccttcaccgaaactatagttcgactccgggtctacccggtgctcccggctgatttgtgccaggtccttcttgcgttcgcgtacatctttgccacgctctacgacgacgggacgcagccccagttctatcagtcgcagtgcggcaaacaatccgccgggtccggcgcccacaacaattacctgtggcttgtcttccaccttattatatatagtacgttcgtattcatcatccgtcggcatttcattgaggtatacccgcactttcaggttgacgaagatggtgcgttgccgggcgtctatgctccgtttcagtatgcggagagaggttacatcacgcaggttcagccctttctcctgagaaaggtatgttttgagttgctgctcgttggcggcaatttcagggaggattcgtagttggtattcttgtatcataggttcaccacagattacacggattaacacagattgttattttaaatcacataccgtttaattccgttttgaaggtttgttatattgaagttgattaatagtcctaaatggtgtttggacaattttaaataggtcattatttgagccgtatgaatggggagtaaggcttctacggatttaagctcaagaacaatctgcctctctaccagtatatccatgcgatacccgttatctaatttcatttctttgtaataaacaggtagttctttctgtctttcatattttatacctgctttatcgaactcgtagcataggcatgcttcataggtactttctaaaagtcccactcctaaagtcctgtgaacttcataggcacatcctatgattttatatgatagttcgtttatattctccatcttgataatctgtgttaatccgtgtaatctgtggtgaactcatccgaagagtccccggaacgcctcttccacctttctcaccggcaccagttctatcttcagcttcttcatgtcgattccctgcatattatacttaggcaggataaaccgtttgaatccaagcttctcggcttcaccgatacgttgttcgatccggttcaccggacggatttcaccggacaacccgatttcacctgccatacatacttccggttcgatggcggcatccatattggatgaaaggatggcactgataacagccaggtcgatggcagggtcgttcaccttcagccccccggcaatatttagaaagacatctttctgtgctaacttgaagccgacacgtttctcaagcacagccagcagcatgttcatgcggcggatatcgaatccggttgccgaacgttgcggattgccgtaaacggcggaactgacaagtgcctgtgtttctatcaggaacggcctgactccttcgatggcagatgcgatggctaccccgctcatgccttcgtgatcttgcgacagcaacagctccgacgggttgctgacctggcgaagaccatcttgccgcatctcgtaaatacccagttcggccgtactgccaaagcggttcttgatgctgcgcaggatgcggtacatataatgctggtccccctcaaactggagcacggtgtctacgatgtgttccagtacctttggaccggcaatgctgccttctttgttgatatgcccgatcagtaataccggagtatgcgtctctttggcaaaacggagaatggaggccgagcactcccgcacttgcgcgatacttcccggcgaagactcgatgctttcggtggatatggtctgtatggagtcgatgattaccaggtccggacgtgtattcttaatgtgcacatagatctgctccaacgacgtttcgcacacaatcaggcagtcgctcgacgtttgtgtcagtcggtccgcgcggagcttcagttgccttgcactctcttctccggagatgtagagtatcctgcgttcgggcatgtggagcacggtttgaagtaccagagttgattttccgatacccggttcgccaccgatcagcaccagtgatcccggcaccagtccgccgcccagtacccggttcaactcctcgtcgtgcatgtcgatgcggggttcctcgtccgcttcgatctcgttcagggtgacaggtttggctttaggcgattcgatgcccgataccggacgtttattcggaacctccttgcgtacgatttcttctacataagtattccactcgccacacgaaggacacttgcccacccatttgggtgattcctgtccgcagttactgcatacataaacggttttctcttttgccattgatctcttgataaataggtctcaaagttacgcatttcgtctttttctgccaaacagaatatagcttttgacttttgaatgccgggaagccgttattcttttggataaagcatctggccgattgtcagcgaaatgaacggattgctgactcaatgtcgcctattggccggcttcgctgacaagctttgtgcgataagattgcattccggaaatggaacttgaataaatattcccaaataactgcatattccgcatttccgtcgttagtttattcggttttagggctccaggttattaacttcgttgcggtaagatgctaatttcatagcggcaggatgttaacttcgtgacggcacaatgttaacttcgtgcaagtagagtgtcaacttcctgccggcagaggcttcgtttcctgaaaagagagcctctgccggggagagattgtacttcttgtagcgctggttggttatggatcttgatcgggctgaagctgttgaaaagatggtatttggtaactatatccgtctgaatcgggcagaaaaggtttctttactttcctcttgtttgagaaaaacgtgtttcagtatcaatctgattgtgtcttaaacgaaatgacggcgttttttgaaccattctttatcctgtgcccggaataatggattctgagctcttaggaatatcgttttgacaaaaagataattgcttcttttattgccggcggatctgtttggatactgggtgctgttattttattctgtaggttttgagtaaattcgattggtaaatattatctttgtttggataattataaaagcatgacactatgacgattgcagttgattttgacggaacgatagtgacggaccgctatcccggcattggtaatgaaattccttttgcggtggaaaccttgaagctgttgcaacaagagcaccacagacttattttatggagtgtgcgcgaaggcaaactactggacgaggccgtggcatggtgcaaagaaagaggggtggagttttatgccgttaacaaggaataccccgaacaaaaacttcaggatgacggattctccaggaaactgaaagccgatctctttattgacgaccgtaatgtgggaggactgctcgattggggtattgtataccggatgataaaagaacacaaaacgtaccgggacatttatgcttcaggagatgatgtcctgaaaaagaaaaagagagggtggttttaagagaatgccgtttgtgcagagtttacgtctgccgtcgtaacagcattctcttttgaaaagatgaaatgaaaagttggtattattgatgatacgtttaatgggtatgtccatatccgtaaccgtatccgtatccgtatttcttctctgacagattaccaccgtttacaatcagtgaaatgtggtttaaccgtcctgtacgttccgtattcacaatctcaggcaatacattcttgtaggtataatttatgcgacaaacgtatagtgtgaaatccgtcactttgcttaagctcagcgtatcactggctaagccggtaggtgctgagtctacaatgatatagtcgaagtgcttccggaagtaagtaaaggcatctttcagtctttccctttccaacagttctgccggattgggagggacaggacccgatgggaccacgaataacagttcgtgcacccccgatggataaatgatactttccggttttacctcgtttccggcaaggaaattcgttattccttgccggttctgaatatgaaaatgctctgctaaccgggggcgtctgatgtctaaaccgacaatgagtacccggcatccgagaaaagcaaaggaaagggctaagttgatactgatgaagctcttgccctctccgctggtggacgaggtaatgagtatgcacttctcgtctcctttttccgtcaagaaacgcaggttgcttcgcagtcggcggaaagactcttccataagcccgttcttgccttcggtcacaccgatttgttctttatcgaggggaatcgtccctactatgggaagttgtatggtttctacctcggatattgatgaaatcttggtacggaacatgtctttgaacagaatcagtcctatggtcatgatgcaagctataaacaaacttcctgcataaaccatcggactcttgggggcaataggagcatcggcggttaacggtgcgtcgatcacccttgctttatttatggttgccgccaaagagatggtggcttgttcgcgccgttccaatagcatcagatacaggttagccttgatctgctgttggcggtctatgttattgaactctctctcctgtttgggcatgttgccaatacgtgaattgaaatagttcgtcttgcgtatgatatctttgcgggcaatctcgagtccctctttgactcctgtgacagatgacaagatgttttttcgcaaagctgtgatgtttatattttggtttacgatggtaggattgtccggcttcatggtattcaacaggcgttcacgttccagtagttccttattgtattcgttaatcagacgcatcagttccatgtccgaaatcccggtatttaccggcaatagggagaagtgatactgttcatctttcagataatcgtagatgtaggtggtcatgttcaattgggtttccacttccagcagcttcttttcgtattcgttgttggtgttcaagtcgagatccatgttcgttttaagatcgatcagtctttccttttctttatactgttccagatgtttttctacaaatcccaattcacggctgatgctgtccagcctttcctccagaaagatcaatgtatttcctgttaccttatttttgtcgttcatggcatcgcggttgtagacttctatcagtttgataagaaatgcttctgcccgcttcttatctgtatctttgaaagtgaggctgatgatggatgtctttttcgaggttgtggcaacggtcagcttttgcaagtaatggtttactgcgtctgtcggccggcagatatttaccttgacggtccggtcgaaagttctattgggaagtaactccaaggtacataatcctgccagagtctttatggttgcgggaaaggtggtgaaagattctgtcaggcaaatgtcatgcagggcacttcgcgcttcataatgatcgcccattttctctatttgtatcagcagtgcctcctgtaaagtatccattgcggctttctccaacgtcacgctgatgggaggggtggtggtctccgtatatccgagtccttcctttattctataggtcgtgtgcatattcagttcgttgatgacttgcaataatatggatcttgaacgcaatatttccagctcgtcttctatctgagtatttgttgccgccatattggacggagatacttgattaaacagatcgttgattgctttatcgcttccttcagaatctttgatcactaccgaggctgaagcctggtataccggtgtggtgatgtgtacatagatatatgcgcctgtcagtgcgacagcgattgctatcaggaaccacctccagtgtactatgactttatagaatagttcgattaagtctatttcctgttcttgttgtttctgttcgttttccatggggcgtaatttgttttgttatcttaatatggtcacaatcagtccggccattgatattaatatagatgtgatagaaatcagcagattggtggaagaaccgatattggctccctgtgttttggctttattgggttccacatatacaatgtcgttctggtgcagataaaaatcggaagagtggatgacgtttacatcattgaggttgacggtgattaatcgttgccggttgttttctttgcggatgatgcgtacgttgttccgtttgccatagatggtaaggtcacctgccattgctattgcttcaagaagattcacttgttcattgtttaccgtatatatgccgggatggtttacttctccgattacggagattttataattcaccaggcgcaccgtaacaatgggctgttctttcagatagcgtttcagcttctcggcgatcatatccgaaatctcctgggttgtcattctctctacctttaactctccaagtacgggtaaggtaatccttccctcactgttcaccagatagttttgcaggatcggttggctcgtcgagttggtggtattaagctcgttttgtgatgtgggtactattaaattgaaagggagggccgcttccggttcggagcagctaatggaaatcgtaagcaaatctttcggcatgatacgggcattgaactctacaggagcattgttctgctccgtacctaactgctgtaaataagctactcgtttgcttgaggaacacgatgtgcagagaatgcaccaaaataacgctgtccatacggtttctttcatcattgtatatcgctgcccgtcattccccgaaccggcgtttgagtaaataaaaaaagcgtgggaactgttgctgttatctgtcaaagaggcatcgccaaacgcctgagtatagataataaagacaacagcccacgcccaactatatactattgaaggatatacattgagcatgagcgttttgttgcctattattcttatactcctctgaaattggcgatttcctttgacaagaataatatggtaaacgcttctaactacttaaatatgtttagtttaaaagatacatcaacgctctctaaactgagtgcaaaaataatcaataatttataaaaggcaataatattgattctttatttcatcataagtccggtttaacttttttcttttatggaatttgccataaacaggaggcgatagaaagaaggaagcggttcccggtaagatggaaagaagacggcatggagcttgctattctacattttttatcctctttcggagcttatctgtatttttatcgcaaaataatcgcaaaaagtgatagattgaatgaaattattcttatttttgcaacatcttatcaaaatcaaaagtagaaacagagacaatgatgcattactatccacatacagtcacatcgatgtgtatcctgatgatcgggacacaggggacaatggggatgacccttaggggttaatatatagtatgatgtgtatctacgtgattcacgcttacaggaagtaagcaaaactcaattttatattttattatttgtatcaacaaaagtggttttgtatgccttaaggagcgtacaaagcattccattaaataagtatctgcatgaaagtaatgaaattcggcggaacgtccgtaggttccgtgaacagcattttaagcgtaaagaaaatcgtagagtctgccggtgagccggtaatcgttgtagtgtccgcattgggcgggatcactgaccagttgattagtacttcccgaatggccgccacgggcgatgcagcttacgaaggggcatatcgggaaatagtacgccgtcacgaagaaatggtaaagggagtgattcctgccggagaaactcaaactttgttgcactatcaggtgaatgaactgcttgatgaactgaaagatatttttcagggcatttatctgattaaagacctttccccgaaaacatccgataccattgtcagctatggtgaacgcctgtcttcactgattgcgtcacggctgattcagggggctgtgtggttcgattcacgcacttttatcaagacagaaaaaaaacacaataagcatacactggatacggaactgaccaatcggctggtgcgggaggctttcaaagagattccacaggtatcactcgtaccgggatttatttcttctgataaggtttcgggagacgtgaccaatctgggacgcggtggctccgactatactgccgccgtcattgccgcagccctcggtgccgatagcctggagatatggacagatgtggatggctttatgactgccgatccgcgggtgatcagtacggcctacaccatcagtgagctgacctatgttgaagcgacggagctctgtaacttcggtgcaaaagtggtttatccgcctaccatctatccggtgtgtcacaagaatataccgattctgattaaaaacacatttaatccggatgggcagggaacggtgatcaagcagcatgtagaccatacgaagagcaaagccatcaaaggtatttcgtctatcaacgacacgagcctgattacggtgcaaggtttaggtatggtgggggtgatcggtgtaaactaccgcatctttaaggcgttggcaaagaacggcatcagtgtgttcctcgtttcgcaggcttcctcagagaacagtacctctatcggtgtgcgtaatgccgatgccgatctggcttgtgaggtgctgaacgaagagtttgccaaagagatcgagatgggtgagatctcgcctatccaggcagaaaagaacctggctaccgtggctatcgtaggtgagaatatgaaacatacaccgggtattgccggaaagctgttcggcacgctgggacggaatggcatcaatgtgattgcctgtgcgcagggagcgtccgaaaccaatatatcgtttgtggtcgattcaaaatcactgcgtaaatcgctgaacgtgatccacgactctttcttcctctcggaataccaggtgctcaacctctttatctgcggtgtgggtacggtgggtggaagccttgtcgaacagatacgccagcaacagaagaaactgatgatggagaatgggctgaaactgcatgtggtgggtatcatcgatgcgacgaaagcgatgttcagccgtgccggattcgacttgggcaactatcgtgaggagttgaaagagaaaggaaccgacagttcgctggacactatccgcgaagagattatcggcatgaacatattcaactcggtatttgtggattgtacggccagtccggacattgcatctttgtataaggacttcttgcaacacaacatctctgtggtggcggccaataagatcgctgcttcgtcggcttacgagaattaccgcgaactgaagctgatagcccgtcagcgtggtgtgaaatatctgtttgaaaccaacgtgggtgccggacttccgattattaataccatcaatgacctgatacatagcggtgacaagatcctgaaaatcgaagccgtcctttcgggcacactgaactatatcttcaataagatcagtgccgatgtgcctttcagccgtaccatcaagatggcgcaggaggaacgctactccgaacctgatccgcgtatcgaccttagtggcaaggatgtgatccgtaagctggtgatcctggcccgcgaagccggatataagctggagcaggaagaggttgaaaagaacctgtttgtgccgaacgactttttcgaaggttcgctggaagacttctggaagaaggtacccagtctggatgctgacttcgaagcccgccgcaaggtgctcgaaagcgagaataaacattggcgtttcgttgccaagctggaaaacggtaaggcatccgtaggcttgcaggaagtggaccgcaaccatcctttctacggactggagggtagcaacaacatcatcctgctgactaccgagcgctataaggaatacccgatgatgattcagggatacggtgcgggtgccggagtgacagccgccggtgtgtttgccgacatcatgagtattgcaaacgtataaaaagaagcttatgaaacacatcatcctgttaggcgatggaatggccgactggcctgtgaaatcgttgggaggcaagacgctcctgcaatatgcaaaaacgccttatatggataaactggcccgcatgggacggggcggacgattggtgaccgtagccgacgggtttcatccgggaagtgaagtagccaacatgtcggttttgggatacaatcttccgcaggtatacgaagggcgcgggccgcttgaggccgccagtatcggtgtagatctgcagccgggcgagatggcgatgcgttgcaacctgatttgtacggaaggggatatcctgaagaaccattcggccgggcatatcaccacggaagaggcggatgtgttgattcaatatcttcaggagaagttaggtgacgaccgggtgcggttccataccggtgtgcaataccgccatttgctggtggtgaaaggggggaacaagcagttggactgcactccgccgcacgatgtgcctttaaagcctttccgtccgctgatggtgaaaccgctggtgtcggaggccgaagagacagccggcttgctcaacgaactgatcctgaagtcgcaggaactgctgaaggatcatccgctgaacttgaagcggatggccgaaggcaaggaccctgccaacagtatctggccgtggagtccgggttatcgtccgcagatggaacgtctgtccgatacatttccgcaagtgaagaggggagccgtaatctcggctgtcgatctgatcaacggtatcggatattatgccggactgcgccgcatcgcggtggaaggggcgacgggactgtacgacaccaactatgagaataaggtggccgccgcattggaagccttgaggacggatgactttgtctatctgcacatcgaagccagtgacgaagccgggcacgaaggtgacgtggcactgaagttgcggaccatcgagaacctggacagccgtgccgtaggccctgtctacgaggcggtgaaggattgggacgaaccggtggccatcgccgtattgcccgaccatcccactccttgcgagctgcgcacgcataccaatgaaccggtaccgttcttcatctggtatccgggcatcgaaccggacagcgtacagaccttcgacgagatagcagccgtggagggcagctacggactgatgaaggaggatgagtttattaaagagtttatgaatcattagcgaatacggttcaccacagattacacggattaacacagaacttttaatcttaaatatcaacgatctatattattaatctgcgaaaatctgtgtaatctgtggtgaaacggaaatgaaacatttagcgcataatcattataaaagtatctatgaaatattatagcacaaacaagcaggcaccgcttgcttcacttgaagaagcagtggtaaaagggcttgcttccgataagggcttatttatgcccatgaccatccggcgtttgccgcaggagttttacgacgagatagacagcctttcttttcaggagatcgcatatcgggtggcggatgccttttttggcgaagatgtcccggcggaaatattgaaagagatcgtttatgacacattgaattttgatgttccgctggtacaggttaaggacaacatctactcactggagcttttccacggtcccacgcttgcctttaaggatgtgggcggacggtttatggcccgtttgctgagctactttatccgtaaggaaggcaggaagcaggtgaatgtgctggtggctacctccggagatacgggcagtgccgtggccaatggctttctgggagtggaaggcatccatgtgtatgtgctctatccgaagggaaaggtgagtgagatacaagaaaaacagttcactacgctggggcagaacatcacggcactcgaagtggacggcactttcgacgactgtcaggcgctggtgaaagcggcctttatggatagtgaactgaacgggcggttgttgctgacttcggccaactccatcaatgtggcccgtttcctgccgcaggctttctattacttctacgcttacgcacagttgaaacgggcgggacgggcagcgaatgccgtcatctgcgtgccgagcggaaacttcggaaacattacggcaggcttgttcggtaagaagatggggttgcccatccggcgttttatcgctgccaataacaggaatgacattttctatcaatacttgcagacggggcggtacaatcctcgtccgtcggttgctaccattgccaatgcgatggatgtgggcgatccgagtaactttgcccgtgtactcgatctgtatggtgactcgcatgcggctgtcgcagccgagatttccggtgcgacgtataccgacgggcagatccgtgagactgtgaaaaccgtatggcaggagaccggctatctgctcgatccccacggtgcatgcggcttccgtgccttggaagagggcttgcagccgggtgagacaggtgttttcctggagacggcccatccggcaaaattcttgcagacggttgaggccatcatcggtactgaggtcgagatacctgccaaactccgggcatttatgaaaggtgagaagcaaagcttgccgatgacgaaggagtttgccgatttcaagagctacctgctgggcaggtagaaactcacccctgagggtacagggagacacatgagggcacagggtaacgcagacgatttaggtcatggattattgacgtgaatactctgtgccgctctgtgccctcggtggtgaaatatgctttttcccccgccgccggcttttcccccggattcgcttccgcgcgcatgcggttttttttcgttccacatgcgggtgaaagccggttcttgtgtaaaactaaataactggaatccgcttcccgctccgggctttatcgccctccttttcccgaactttccgccgcctcttttgttgtaccccaataaaacctaaccccttgtgtatgatgaagaataaaaaagtggaggccaatctgagcatggtggtgtccaaaacctttagcggattgaatatgaatgcgttgaaatacctgcttcccgtgtgggtcagccctctttcgggagtggccctccggtgcgtgtttgccgccgttgctttctggatcatcggaatgtttgtcaagcccgagacttctacccgcaaagaaaagatctaccttttcctccttggtgcgttgggcatttacggttttatgtttctctatctggtggggctgagtaagacgacccccgtctccagttccattttcaccagtctccagcccatttgggtgtttgtcatcgccgttgtcttcttcaaagagaaaatcagtgtcctgaaggttgccggcatctccctcggactcggcggggccatcctctgtatcctggcacaaaagagtgacgacttggcttcggacgccctgacggggaacgtgctgtgcctgttgagttcgattgcctatgccatctatctggtggcgagcaaccgtatcctgaaatcggtcggaatgtttacggtgctgaagtatacctttgccggagcagccttttcgagcattctggtctctgccatcaccggttttcacgcaccggtattttccggaccggtgcattggtttccgttgtccgttctcctgttcgtcctgattttccctacggtcgtcagttatctgctggtgcccataggactgaaatatctgaagactaccgtggtcgccatttatggttatctgattctgatggtggccaccatcgtttccctgttggtcgggcaggaccgcttcagctgggcgcagaccattgccatcggcatgatatgcatcagtgtctatctggtcgaggtggcggaaacgaaggagaaacctctcagtaattcagataaaccaggtagtctccctccgcatggatcgtgaattcgtcacctgtcgcctcgttcagtgtcccttgccaccagttgtcgaagtcgctgagcgggtataccaatccctctcctctgagtccggtggcaccgaagttaaagacagaaacctgttgtccggggcgtgatttgaaagtgttccgtcccgatgcggggacgaacatgccatgatcggtcagcatcgtcacctgtgctcccaccttcatataatccatcagcaggctgatgtttcccaatgtatggtcttcccgtttgccggttgcacctacaaggatgatcaccttcttgccttggtccagcaggaaatggaccgctttggtctgatcgttcgtctcctggtcgtctatctgatggaatatttccctgaaacggtctttattctccgccgagagggagtccccgtcaccgatgatggcattcgggatgaatccccggcggatgtgttcatcggccgatccgtcacagcataccacatagggagccatgatcagcatggtttcgggcatggagtgggttggatattcgccgttgcccagtatcacggcatccatatcgatatcatttactttcatagtgcatcatttgtttccatttaaagtagccaaagatagcaattattgagtaaagtccgtaaagggcggatgtgaaataaagctctttgtagatgtagagtccgcagcataccacgtcgaccagtatccatgcccaccattgttctacgtatttgcgcgccagcatccacatgccgatgatgctcagtgccgtggtaaacgaatcgagccagggtacgttgctgtccgtgaaccggatcagtatccaggcaatgccgaggaaggctgctaagaataccgcggtcagcggaagataccttttcagcggagtatgtgtgatggggagttcggctttcgactcccggccggcaccccgcatccagacaatccatccgtaaacggccgccagcagatagtagatgttgattccgaagtcggcatacagtcccgcccggtagtagacgaagatgtagatggcaggcatgatgatgcctgctatccagaggtaaatgctggcacggtattccagccagagataaatcagcccgatcagggtgcctgtgatttcgaggtagttcatggcttaaaagcggatggaaatgttacccattacattcgttccggcctgtgcggcgtagccggcatagttgtagcgctctacctctccttttactatcttataaccgctgcctgcatatccgttgttttcgtactcggcattgaagaggttgtagatggtgaatcctgccgtaaccgactttacgtgagggagcttgaaggtgtaagccaggttgaggttgctcacgaaataggcgtccagcgtctggtcagcctgtctggcattgctcatgtactgcttgctgacgtattgtgattgcaaggcggcctcgaatccccggtagctgaacgagaagcggttgttcaggatcaggtccggcgagaaggcaatcggtgtatttccgtggctgacctcgatcggattcttccattcgtcttcatacagcttttcggtgaagttcttcacccggtttttgctcagtgtaccgttgatgtcccactggaaccattggcagggcttcacacccagcatcagttccattcctatccggtaactgtcgggcacgttgcgcgccatagcctcgcctatctcgttcagctctccggtcagtaccaactggtctttgtagtccatatagtagaagttggccccggcgctcagccaagtgttccggtaggtatatcccaactcatagtcgagtagcttttccgcctttggatactcgtccgcgttgccgtcggtatagttgttccgtgtcggttccttctgggcgatggagaacgatgcgtaaacccggttgctggcgtctatgtcccagttcagcccggctttcgggttgaaaaagttgaagtgatcgtttaccgccagcttttgcagggcgtccgcgttgtagtcaaacttatcgttgtcgccgtttatcttatagttgatgtagcggtattgcaggtcggcgtatgcattgagccccgccaccaggttatagttggctttcagatagaggttgccgtccgtcttcttcgctttattccggtagtattcgtggtcggggagcagttcgccgatgtagtttttcacccagatcacccgtccgaagtgccatccgtcataatggttcagcgcacctcccagtgaagcgttcagctttccgttctgataatttaccgagaacacgccgccaccgaagtggttgtccatcttcttctgacggatcaggtcgctcttgtccacctctttgccgtcgtgcatgaaaggtggcaggcgatactctttcagtgtccggtcctccttatactcctgataatatccgtctcctttcgtataatggagtgctgcgttcaggttccattccggcgagaaagtgtggttcagcaagagctgatagttcatttgcagatagttgtccgtctggtctttgtagaaacggatgttgccgtcatcatccgtgtacatgccgcacgagttgaaacgtcgtccgtacttttccatttcctccttgctggcataattccaggcatgatacgttttctcttttccgccgaaagtgatgaacttcaccgaagtgttgtcggcgaaatatcccccctgtgcataaaaagaataaaggtctaccgaagcccggtcgatgtatccatccgtaccgatgttggacaggcgggcatcgaaggcccaatggtcgttcaacagtccggtaccgaattttaccgtttctttgtgcgcattgaaggttccgtacgaagcattcagttcggcatacggcttcatcgaaatcccctccgtctgcatattcacgctggcaccgaaagcaccggcaccgttggtcgaagttcccgcaccgcgttgcacctgtatatccttcaccgatgaggcaaagtcgggcatgttcacccagaaaagcgtatggctttcggcatcgttcatcggaatgccgttggcggtgatgttgatacgtgtcccgtccgttccgcgcacacgcagggtggtatagccgatgcctgccccggcatcactggtggtcagtgccgaaggtgtcatactgagcagatacgggatatcttgcccgaagttctgctttttgagttcctctttcgacacgttggtaaatgctacgggagtcttcgaagtggcacgtgtggatactacctgcacctcttgcaggtttactactttcaagctgtctgtctcgcccgcttgcgcgaagacgcttgctccggctatcagacagccggcaaaaatcatctttttcatgttgctaatttatttttctctacgccggcattacccggatcaggtcaaagggtatgttctcagcccgtcatgttaaggcacccctactcagtgaatcggtggcaaatttacgctttttgggcgtgttaagcaagaaacacttcgctatttgataaaaacattgtagctttgtctgctgttattaaatgaaaaacttctaaaattgtactattatgctactattctttcaagccgcgcaacaagtggcagactctctgcaggtggcggccgataagcttgatcaggccattgcacaggccgatggactggataaactggctctggttacccagcagttgatcgattcgggtatacaggccggaggtcacatcctgaaggctgtgattgtctttctggtcggacgttttctgatccggatgctgaaccgacttgtaaggcgtcttatggataagagaaatgtcgatatcagtatcaaaacttttgtaaggagcctcgttaatatccttctcaccgtattgctgattatttccgtggtaggtgcattaggagtggaaaccacttcgttcgccgctctgctggcttctgccggtgtggctgtcggtatggctctttcgggtaatctgcagaactttgccggcggactggtcatcctgctgttcaagccttataaggtgggcgactggatagatgcacagaacgtttccggtactgtcaaggaaatccagatcttccacactatcctgaccactgccgacaataaattgatttatgttccgaacggtgcactgagcagtggggtcgtgactaattacagcaatcagacaacccggcgggtagagtggattgtcggtgtggattacggtgaagattataataaggttgagaaggtggtacgtgaggtgctggctgccgataagcgtatcctggatgatcctgctccctttatagctctccatgccctggatgcgagcagtgtgaacgtggtggcccgtgtctgggtgaacagtgccgattattggggagtatatttcgatattaacaaggcgatctatgctacattcaacgaacaaggcattaacttccccttccctcaactcacagttcatcaggcacccaactgataactcatgcaaaaagggtggctacttcgtcggaggtaaccaccctttttcaagatttatatttaaccgattaacacactccaaaatcttctgtcggatcatacgtgttgtctgtgatgcctaacagatggtttatctctctccgcttatccaaatccttgaaataggtttctaccactttgtaaagatcgaaactgaatgtagatccggctgccatatccaatgactctaccatctgttctactgcctggtggattctttcttgatcgatcaggtgcagctcattactgtgaataagatatttttccataaccgttgttgttttaaatttctacagataaaacattctgaaagagtataaggttcaatctgttttttcttatctttgcggtctctgtattttgccttaaatctttaagtggggaatattcgataatgaatcagttcttagactttgaccagaaactgtatgcagaacttcgtaaaggtagcgagcatgctttcgttactgttttccggcagtacaatcgcttgttgtatgcattggcctatcggtatttcaaatccggtgaagaagccgaagatgccgtacaatatacctttatgaaactgtgggaacagcgggaaaggtttgactttcagtccggaatccggagtttattatttactattttaaagaactacatactgaatgaattacgacatcgtaatcttgttttcgagaaacactatgaaatggcccagaaagacgaagaagccgatgatggtttcctgaaagattttgaggataaagacttcagggagcatctccgggccgctatcggcaaactcccccctcaaaagcaaagaatatgccgtttgaaaatagagaaagggctttccaatcaggaaatagcggacgagatgcacattacggttcctaccgtaaaatcacattatacccaggccattaagatacttcgtgcggaaatagaatcgttgattgtactacttcatgtattgtggattcattttttagggtgagtgtcaactcatacttttaagttggtgaagtgtttttattagtagataaagaaaagtagaaatgaaaatagatgatgcgattatagataaggtgctcaataatgaagcttctgcagaggaggctggaaaggtggcggaatggtttgctacagaggaaggtagccgctatctgtcggaacggctggaaaatgaatctttgcggttgacggaagagcaggccttggattggctggaccatccggtgccggaagaacggatgcggcaacgctttatgggagagatcaaaccacagaaaaaaacaatatcttatcgtcgcggactgatagcggcggctgtgttgatccctttcctttttctcagtttgtcgctttggtttctggccgacagaaccggtgtattctctgctacggagtatgctgaactgaaggttccttgcggtgaacagatgcaggttgttttgcaggatggcacggtcgtacagttgaactcggatactcgtttgcgatatcccaaacaatttgggctgttcaatcgtagtgttgaactgtggggagaaggttattttgtggtagccaaagaaaagaaccgtccgtttattgttgatctgaagggaattgaggtgaaggtgaccggaaccaaatttaatgtgaaggcatatcctgcagagcagaatgtatgggtgacactggaagagggcggagttctgctaaaggattcgaagcataaggagtatcctcttgtacccggtcaaagtgcggaatataacagaaagtccggacgttgccagatatccgaaccggaagatatgaaccagatctcttcctggcgttccaatagcctgaacttttatctcactccgttgaaagagatcataaaagtgatggaacggcagtatgatgttcatttcattgtgcgtgattctactttattgaataacaggtttactctgtctaccagcaaagtgaacgttgatgatgtattgcgtgatttggaggcggtttcatggatacgtttctcacaaacagaagacggggtgttcgaagtcctgaagaaagaatagatggattgaatcatcattcctatatagatagatgcagaccagacaaaagggactgcatctatttttttagatgtactctaaaacagaagactcatactttctttcgggtgaggtgttagcttatgtatactaaaaaggcctttcggaatatttattttgagtatgaaccagatgtctgtacataaagatatcacaatgatcatgtgtttatatgaagtatttgtttactttgttgatggcctgtctcccgttttcctttactcatgggattaagagccatccatcttttctaaattcgtccggacgatgggtagtttggtccgaaaaacctgctgcatcctggcaggatgcattcgttaccggtaatggaagtcatggaacaatggtgatgggacagccgggagaagaaaggattatctgtgtccacgaagaattatttataaggggatgggaccgcaataaagtggcggttccttgcaccgcttctttgctcccgcaagtacgaagtctgatggaatcaggaaaaagtgatgccgcggatgcgttgatgacgagtgaagcggaccgtcagttggttgccatgggagcccgccaacgttggcctttgattcctcatccggctttcgacctgtgtatccggcatacgggtatacctttacaaaccgaaaagcagtatagaaggcagctcgacctggagactggagaagtgctcacttcctggtgcgaaaacgggaaggtgacggaatctgtgttctcgtccagggagcataatgtgaatgtggtccgcttgaaagccgatgagggtaataagatgaatctggtgctgagtctgaaagagactcctgggcgtgaaggtatgcactttgatcataacttggacagtgctttctcatcggtgaaagcagaagccgtgtcgggttggttatcctatcgtaccggctataaatatgatgtcggtggctatgaagggttagcccgtgtgacggttaagggaggaagtatgacggctgaaggagattctttacggataacggacgctgaagaggtgttggtgctcattaggatcactcctctgaaggaggcccgtttatccgtgcgttcgtccgtacaaaaagaactgtcgggtttgccgcttgattatggtaagttgctgaaacctcatagccggatacatggggaaatgttccgccgtatgcagttggatctgggatgttcgtccgactggaagaccgttccgactgagaaaatgctttcgacgattcacgaatgtggggttactcctttgtttttggagcagattcacgcaatgggccgttatctcttgatttcttcgtccggcaaatatccgcctcctttacaaggaatttggggaggaggatggaaacccggatggattggcggatttgtttgggattcaaatattaatttagctatttcggcagcatctatgggcaacttgcacgaatgtgcggagtcttatattggatatgtcgaaaatctattaccgggttggagactgaatgcgaaaaactacttgggatgccggggctttcttgtagcccattacaatgatccggaaaatggatatctgacccatttcggaagatctttcccctggatgttctgggcgggtggggccggctggaatatacggccattctacgagtatgctatgctgaccggtaacgaaaccttcctaaaagaacacgtattccccctctatcgggagatggccggtttttatgaagattatcttattatgggctgtgacagcctttatcatatctgtccgagtgtttcaccggaaaacgtacctcccggaactgatacctggctgagcaaagatgctacgatggatgttgccattgccagagaagtgtttggcctgcttctggagatggggcataagttccgtgtggataagaaagaactggaacggtggagtcattatctgcaacgcttgccggcctatcggataaataacgatggggcattggccgaatggattgatccccattatccggatgtgtataaccacagacatctttcacacttatatccggtgtttcccggttcccggttgggtaagtcaaaaggagattcccgtcttattaaagcggcaggtgtagctttggacaagcgttttgccttcgataccggttcggctcatggactaatccatgtggcactacaggctgtacggctgggagatatagagaaagtgaagaccaatctggaccgcttttgccgccgccattatttatatgacggactggttacctcgcatgatcccgagcatcaggtttacaatctggatgcggttttgagttttccgcgtcttttgatggaaatgctggtttatacggaagaggggaaaatagaactactgccggcttggcctcatgaatatgccgatggctgcataaaagggatacaggtgtacggcggacacacattggatattacgtggaaatccggacagctggtggaagccgtcctgcatgcacggcaaaacgaatcctatgaagtagtttatggggatcggagaacacgattacagctacgtgaaggcaaggcttatcatttctctgcaccattttttgcagaaaaatgaaaatgacactcataccttctttgggatggtgtgttagcctatatagaaaggcctttttataaatcataaaaataactaatttaatactgtatgaaatgaaaacaagaaccagaacgaaaatgctgttgctcttaggagttcttttatttggcttcactgtttcggcatggtcacaaaaagtttctttaaattttaataatgagagggtagagaaggtactgtcttctataaaaagccagacagggttagggctggtgttcagcgatcagttgatcgacgtaaaccgtaaagtatccattcagttgaaagatgccactctggaggatgcgttgacaaaactattggtaggaacgaaagttacttttgaggtaagaaataataagatttattttattgaaaagaaaacggaccaacaacccggttcccggaagaagaaggtatccggagtggtgaaggacgctatgggggaacctgtcatcggagccaatgttgttgaaaaaggagcaggcaccaatggggtgataacaaatctggatggggagtttacgctggaggttccggagaatgcttctttgactgtcagttacatcggctatctgcaacaagatgtttcaacaaaggggaaggatgcgtttaacatcattctgaaggaggataccaaaaccctggaagaggtggtagttgtgggatatggtgttcagaagaaagtgaatctgacgggagcagttgctgctgtcgattccaaatcattgcaaaaccgtccggtgactaacgtatcgaatgccatccaagggttattgcccggtgtgactgtcatttccggaaccggacagccgggaagtgacaatacaaccattcgtgtgcgtggtgtcgggactttaaataactctaatccgatgtatgttgtggatggtttacccgtatccagtatcaatgaggtagatcccagcgatatcgagaatatctcagtactgaaagatgcttcttcagcagctatttacggttcacgtgcggcaaatggagttatcctgattactactaaaaagggaggtgataaagcacctactctacgttatgacggctatgtgggctggcagaaacctacagctcttcccgaatatcttcattcatgggaatacgcaaagctgtacaataaagccatggttaatgaaggtaagaaacctatttatacggacgaagagattgaaaagttcagaaacggttcagatcctgacaactatcccgatacggattggcaaggactattctacaaaaccggtttgcaacacagccaccgtgccgagatttcgggaggtacggataagatgacttatatgttctctgccggttatctgggacaggacggtattatcgatattgctaaatacgatcgctattcggtacggggtaatatgaatgccaagatgggaaagtttacagcagggatgaacctttctttcacgtatggtgaggcacaggaacctgtgagtggttttaccggtgagatgtctaatattttttcacaaatcaaccagatcgccccttttattccttataaatattcaaacggatattatggatatgccaatgacggtaacccgttggcttttatcgaggaaggcaacttgcgtaccaccaagcaacacatcaccagagccatcggaaatgtgagctatgaaccggtcaagggattgaagattcaggaaatcgtgggttatgaatataaatcgatctccgacgagaagtttattaaggatatccagtattataactggaaaacaggagagcctacaaaatatcagggacctaacagtcagactgatgaacgtaagaatgggctgaaactgaatttacagacactggtcagttataacaatacgtttggaaaacatactgtaggtgcactggcgggatacgaacaggaatattaccgtgaggactggactaagggataccggaaaaatttcttgaacaatgatctttgggaattgaatgccggttcacctgatggacagacagccaatggctcagccaatgaatacgcattgcgttcattcttcgggcgtctgacctacgactatgacaatcgctatttggtagaggcaaatatccgtcgtgacggaacttcacgcatctttaaagactcccgttggggtgtgttcccctctttctcgggagcatggcgaatcatcaatgaaccgtttatggaagaaacccgcaatgtactgtccgatctgaagttgcgtggaggttggggcattctgggcaatcaggctatttcttactattcttatcaatctgtacttgaccaagccaactattccttcggcggaacagttgtacagggagtggctccggtagatggtgctaaccgtaaccttgtttgggagaccacagaaacattgaacttcggacttgatatgggattcttgggcaatcagtatactttgtctattgaaggataccgtaaactgacttatgacattctgatgaaattgccggtgagcaccttgtacggtctgaatgctccttaccagaatgcaggcaaggtaaaaaataccggttttgaaatgaccgcaggctataaactgaatactcatggctggaacttccaggtgtcggctaatgctgcatataacaagaatgaagtacttgacctgaagaatggcggagcacgcatctggagcggtaagtattttaatcaggaaggttatgccatcaattctattggaggatatattgcggaaggacttttcaaaactgaagaagaggttgccaatagcgctacgatacccggtaccgagactgcacccggtgacatcaaataccgtgatatcaataatgatggaaaaattgacggagaggatcgtgtttatatcggtaatacaatgcctaagtggactttcgggctgaatctgtttgccgaatggaaagggtttgatgctactttcctgttccagggagctgctgatgtacaagggtatcttgcaggccccggtgtagtgggcgaaatgatcggagcaaaaggtaagccgtcttatatgtaccgtgactgttgggatgccgaaaccaatccgaatggaaaattcccgagagcattctcatcttaccggcagaacaatagtatctataatccctcctccttctggattgtcaattcttcttatttgcgcctgaagaacttccaattgggatatacactgcccaaagaatggtgtaatgtgatgggaatttcacgaatcagagtttattatagcgggcagaatctgcttacctttaccaaatttgataaaggcttcgatccggaatcacccgaaggaggaagctcttatcctcaagtcaaaacaaatacatttggtttaaacataactttctgatagataatacgtatgaaaaagataatatatagtttgttatttgccgctttgttctcggcatgtagtaccgattttctggatcggaatcctttggacaaaccctcaaacgaagccttttggagaactgaaaaagatgccatggccgcagctacagggtgttataatggttggttttctatggatgaagtgatttatgccgactgtgcgtcggataatgcttataatccttttacttgggaaggctgggcggtacaggccgcaggaacagcgacccctaccgatccgggttatagctatatgggatatggaaacatggttcgctataataatttcctggagaatatccaccgccccgaaatgaatgaagatttacgcaaacgcttgacagccgaagtacgttttctgcgtgcgtgggattattttcagaaagtgacacattatggtgatgtgccgttggtaacttccgtacttgaaattaaaaatgccaatttaccacgtaccgagaaagcgaaagtggttgagtttatcttgaatgaactgaaagagatcgctccgcaacttcccgaatcttactccggaagtgatgtcggacgtattactcgtggcgcagttttgacactgaaagcccgtctggaactgttcgaacaccagtatgatgattgtatggttacttgtagcgaagtaatgggattgggctacgaactgtttcccgattataaaggtttgtttaagattgcgaatgaaaataattcggaagttattctggatatacaatatgtagaaagcttgtatggtaactgggttttaggagtattgcctccggccagtgtgggtggatggtgttctatcaatcctactcaatcactggtagatgcttttgagtgtgaagatggaaaaacgatcgaagagtctgaggtatatgatccgaaagaaccttacttgcacagagaccctcgtttggctgttaccgtattagctccgggaaatctatacgaaggaaaacgttacgacccaattgatgtgaaagatccgaatggagattattatgctccctacggacgttctaaaacaggatatttggttcgtaaatatgtggacgatttgtctgattatgcggatatgtgggattgtggcatgaatgccattgtcatgcgttatgcagaagtgctgttgatgtatgccgaatgtaaaatagagctgaatcagattgataattccgtttacgatattttggacgacatacgtacccgtgctaaaatgccggttgtagacagaacccgatataccggtcaggagaagttgcgcgaattactcagaagagaaagacgtgtggaacttgctatggaaggacttcggtggttcgatatttgccgttggaaaatcggtgaacaagtgttgaacggtaaggtatacggttgtttacttggaacggtcgatcctgtaaccggtgccctttcattgacaaatgaacggatttttgttgagaaccggaaatttgatccggcaaagcattatctgtggcctattccgcagacagtgatcgatgccactccggcaattgtacagaatcccaattattgatttggatggggaactttgaatacttatatacaaagagtgcaatattattgtttgcactctttgttactacagatgtttactcgaattgtgttgaatcatgcccgtcgggtagggaaattcatgtgtcttcttcgcgtggtaatgattcttatggaggagaggaagcccggcctttaaagaccatacaggctgctgccaatattgcgcggccgggagatgtcattactgttcatgagggggtctatcgggaatgggtgaatccccccgttggaggggaaacagcggataaacctattatttatcaggctgccggaggagagtatgtggaaatcaaaggttcggagagaattaaaaactggaaaaggctgagtaatactacctggagtgtagcaatctcgaataatatattcgctgcgttcaatccctatgctgatactttgaaaggagactggcttgaaaaaggtaaatgggcacataccggagaagtttatttgaatgatcgggcgcttacggaagctccacgactggaaaatgtattattaaacaagacagatagtgccctgtggttttgtaaagttactaaagacacaacttatttgtgggctaatttcggtcagaaagacccgaatgaagaattgaccgaaataaatgttcggcaagctgtgttctatccggaaaagccattcgtcaattatattgttgtgcgcggatttcgcatgagccatgccgctactccatgggcaccgccgactgctgaacagataggattggtgggtacacattggagtaaggggtggataatagaaaataatacgataagccattccaagtgtgtcggcattacactgggaaaatatggagatgaatgggataataaatccgaatctgttgaaggctatatacaaactacccaacgggcacttgaaaatggttgggatgaaaagcggattggtaaccatttggtgaggaataaccatatttcctattgtggtcaagctggaatagccggaagtcttggagctgtttttagtagaatagaaacgaatgtcatacatgatatcgggttacaggaaactttttggggatacgaattagccggaataaaattgcatgctgcagtggatgtaatgataagcgggaatcatatctatcggacagaaggaggaatttggcttgattggatggcacagggaacccggataaaaggtaatctgttacatgacaaccagacacaagatctttctttggaagtgaatcatggtcccatactgatagatcataacttgtttttatctccggaactggcgcagattagactttcgcagggagttgcgttcgtcaataacttgattgcctgggagatttggcctactgatagcgttgataagcgtgagaccccttatttagagccgcatggtacatctattatcggatttcatgattgtccttgcggcgacgtgtcctatttcaacaatattttcatgcggacagatttgactccttatgatcagtgtcgtttgccagtgcaaatgaaggataacgtgttttggtcaggggctataccatccattcatgagactatgtgtgcagtagataccactcaacatctggttgggataaggaaatgtgaggatggctggtacttacaaatagatgttcccgaaagttgggagaaagaaaaaaaatgggttattcctactgttggacagttgagatatgcaattatttcaaatcaagcttttgacaaaatgggcggactacctgtgtcgttaaaggaggactactggggtaaaagacgtaagagtaagataacttattgtccgggtcctattgagtttgaagcgaaaggattacaaatgattaaagttttttgtgaagatgaaaagattgtattataggattattttttcttgtttagctattctgtttccactttctctgctttatgcgggggaagtggagacaagaatttcgctgaacatgaatcttggttgggcctttcaccgcggggatattgtaaatggtgaatatcctgatttggatgattccggctggatagccgctacccttcctcacattatgcaattagagaagaaacattgtggaggggatattatctatgatggaataggttggtacagacgcactttcaaggtaccgtcacaatacaaagataaaaagatcagtatctcgttcgaaggagtgatgaacgcctgtgaggtatttctgaacgggcaaaaagtatatactcaccgaggcggatatattggttttgtggcagatctcacttcctatcttaattggaatcaagataatttgttggctgtcagagtttcagcagagtatgatccgcttacacctcccggtaagccacagggaggaatggatttttattattacagtggtatttatcgggatgtggaaatgattattgccgatccgcttcacatcactcatgcattagaagaggatgaagttgccggtggcggagttttcgtcacatatccgatagttgaaaaagagagagctgttgctcatgtaaaaacacatatcagaaatgaaggtcaatatctccggaaggcgcagcttcgtacccggatgattgataaaaacggtaaagtggtagcttgccaacaagactcttttcgtttgttggccggtgaggctctttatatcgagcaagatttaaagatagacaatccttttctgtggcatccatatactcccgatctgtatcaattagaaagtgcggttattgaaaatgataaagtgatagatcattgcgctgaggcagttggtatacgtacgattgcttacacccgtgacgggggatttttcataaacggtgaaccgctttatttgcgtggagcaaatcgtcatcaggcatttgcctatattggagatgccgcttccaactccatgcaagaaagagatgtgatcgatttgaaacgcgggggctgtaatgccgtcagggcagctcactatccacaagatcctgctttcttggctgcttgtgataaatatgggttattggttgtggaatgtattcccggttggcagtattttaataaagattctgtatttatttcccgtctctatgaagtcgggaaaaagatgattcgtcgggatcgcaatcatccttcggtaattctttgggaaacagctttgaatgagagccgttatccggcggaagtggcccgggaattacatgccattgcacataccgaatatcccggcgaccaaatgtatactgccggtgactacttcggacatacggaccgggttgattattttgatgtattttataaacaggtatcccgtttcccgaaagatggagatgtgatgagtaattatccggaagaccagattgcggtgaaaccactgttctgtcgtgagtggggtgacggcgtaggagaaaaacctcgtgtgagtctaatggagaatgaagaggaacaattgaagcagtgccggggacgttttcagcagcttaacggacatggatactttgactggtgcatgcttgacgctaattcacggatggggggacattttttgtggagttataatgattatgcacgtggagcagagcaggaaactatgttttgtggaatggtcgatatgaatagatatcccaaattcagttattatatgatgcagagtatgcgtgataaggatatatcccaacccggattatatgacggaccgatggtatttatcgcgtcacagaatacagctccgcgttatgtctcatccgtgaaagagattaccgtattttccaattgtgatgaagtccggttgtttcgtaatcatcaactgataggtaaacagacgcgcatagagcgtacttcgttttatcattctattgtggagaaagggggaagtccctgttatgtcttcgatgccggaacctatgaagccggtgaattagttgctgaaggactggtagacggaaaggtggttgcaactcacagtgtgcgtactcccggacaaccccggcagattgaaatctggttgaaagaagatggaatacaacccatagcggatggttcggatatgattcctgtctattttaagatctgtgattcgtatggaactcccgttaatacttcagatgtcaggatatatatatccgtatccggcgaagggagtctgataggggatggtatagagcgtatcggggttaatcctcagcaagtagagggtggaatcggatacacactgatacggactacttgtcgtccgggtaaaattcatgtttcggtttcggctgatgggcttaagggagatagccgggagattacgacccgaagatataacggagcgtatgtgcctgagggacaacatgcttcctatatcggaaatgaagaggaaggagcagttgtgaaggcaactgcttgggaaaatataattcgtacaaaaactccgttgaaaatagtgcgggttgaagccacttcggaacagaaacgttatacagccgcatgcattacagatggagacgatttttcgtggtggattgctgacaatgaaactcagcctcaagtagtaacgcttgaactggataaatccgagaaagtgtttgcaagccgtatccggtttcagaaggatagttccacttatacacataaagtggaaacctctatcgacggaaaaaattgggaacttctgtatgaacgtgagtgtacggggtgggattttaagccggtgcagatcggtaaggaactaaaatatatgcgtatcaccattgagaaaagttcggaaggagcagccggactggctgaagtcacaatctataagtaaattgataattggaatataaaaagagactactaccatgaaaaatttttgtttatatattcttttaggatggtttgcttcgctacaatgtttgtgtgctgagaaagaaccggtaaaggatgcggatatacaaaaggtgtacgtaatattcaagacccatttagatgtaggatttactgattggggctctaaagtgattgacacctatacctataatttcattccggcagttttaaatctgtcagaagaaattatgaaagattcgttgtcacagattgattatccctggacttgtgggtcgtggcttatctggaattatttggaaagggcttcaaatgaaaatggacaacgaatgaaggaagctattggtcggggagactttacctggcacgcaatgcctttcacaatgcaggttgaattgtgtgatagtgccatgctgtccgcagcattgaatatttcgaaaaaactggatctgctttttggacggaaaacgattgctgcaaaaataacggatgtacccggtgtcacgaggggggctatttctgtcttaaagcggaatgggattcagttgttgcatgtagggacaaatccgggtgcagctgtggcacgatttccggagatatttcgctggaagaatgctaaaggcgatgccattaatgtaatctatcaatcagactatggcaaaccggtgcatctgcccggaacaaaaactgctgcggttttttgtttcactcatgacaatcatggaccacattccttgaaagagattaagcgaatctatgccggcttaaagcaaaaatatccgtcagcccggatcataccgtcttcgttgaatgaagtagctcttgaattgagtaaagttgagaacagtctgccggtcgttactcaagagtggggagatacgtggatatatggtattggcagtgatcctatgaaagtggctcagttacgtcagttaatgcgtttacgtaatcaatggatacaggatggtaagctaaaggttaatagtgaaatggatacacagttttgtattcctttgctgttaatggctgagcatacatggggagtggatgtaaagtggtatttgaggaattttgataaatatcagttcgatctttacccttcctttttggacagtgaagaagcccggtattccgaacgctcctggagtgaaaagagagaatatatttatcaggctatatccaaactcactccggccttgcaatacgaagcgatgcaagctctcatgaaactggttccggtgaaaaatcaagatactgatttccgttcctaccgttcaaaagcaaagataaataccccattttttcggtttgctttcaatcaggagaatggtacactatgctatctggaagataaacaaaagggcattgtttgggtagatgatacgcagggttggggggactttgcctatcaacgttattccggagccgattttgcacattttattgataggtattgtccaaagaatccggaaggatggatgttggcggattatggaaagcccgggctcgataaactgtctgttacccatgggatatggaattataaggcatcggatatccggataaaaaaggaggtcggacagaccactgtccggattcgccagcaattgaatgaacctgtttatggtgcaccggagtatgttgaaataatatatgtattcccgtatgactcacctgatatcaaggtggagatcaattggtttgataaaccgaagaatcgtgttccggaagctgtttggttttcgttctttccaaaagcctgtgattcgaaagtttatgttgataagatgggagagcgtgtcgatgtggaagatgttgtttataacggagcgaggcagatacacggagtgacgggagacgttctcttttccagtggaaagggaaaattgagtcttgagtctttggatgctcctttggtggcgtttaataatcgtgatttattgtcattcgacaataaggttgcagaccccgatgccggtatccatttctgtttattgaatactctatgggggacgaattatccgcaatggtttggagataatatgaaatatcgttttaaacttaaattttattgaaaatcagatgaaacaaccgtctaagaattggttattatgtgtcctattggggatgatagtgtgttcctcagcaacggctcagaagttgcccgagaaacagtttttccatcccgaccgggtgagatacgacaaagattgctttacaatcgaagggaaagatatttttatactcagtgctgcattccactattttcgttgtccgcaagagttgtggcgtgaccgtttcaggaagatcaaagaagcagggtttaatacagtggaaacttatgtgccctggaattggcacgaacggaatatgcctaagaatgtagatgattattcacaattcgactttgatgatctgaaagcatggctgcgtatggcacacgaggagttcggattttataccattgtccgtcctggcccttttatctgtgccgaatgggcgggaggggcatatccccgttggttggctaaatattgcccggacagttatgacaccagtttctggctccggagcaaccatcccgaacatatgaaatggtctgaacactggtacaatgctgtttgccgggtattttgtgatgaacagcttacacataagaaacccggagagaaaggaatcattatggtgcagcttgaaaatgaatatatctattttgatatggaatctgagaagaaagaagaatttctgcgtgtactgtcagatgcttgtatccggaatggtatcgatgttccccttttcacttgcgtaactcccgaagttcgcggctcgcacgatccggtgatcagtcagttattcgatatggataatcaatatgtatggtggaatatgcatgaagccaagtcacgtattgaaaatctgaaagcagaacagcccaatgctcctgcctttgtgtgtgagttgcagggagggtggttctctacggttggcggacgcttgagcgaagatagctatctggacggacggcatgcccggggaatggcattgatggcaatggcaggaggttctaccgggttgaattactatatgtttttcggtgggacacattttgacggctggggagcacgacgtatgactaccacttacgattatggagctcctttgaaagaaaccggaggcgttggagagaaatatgctgctgtgaaaggaatcggtgaggtggtcggtaaatttggaagccggcttgtcagaagcaagtctgtaccgtttgagatgaaaggaaatgataatctgacgatgggggtacgccgggctacggacggaactttatttattttcttactgaaccgtgataaaaagcaagaattccgtcagatagtcagcttgactatagaaggaaagccgatgcggatagattgtcggttgggggcgcttgacagtaagttactggtactttctcccggaggcacttcgaccgaatggtatccccgtgaacaggtattgccggcacgtccggttgcacttcctgccgccatatcagtaacgaaagtatggcgaaaagacgaagattttcgtggtgactggaagcctttgcgcaaaggtgtatcgcttcccgaattgggtgtgaacgattgccgttattctatgtatcgcagccgggtgaacctcactcaaaaggaagtagatctttacggttcgttggtgttcgagcttttcactggtgacccggtttacgtacaagtgaacggaaagtttgccgggcgggtgtcgagagacgaattggataacacctttatcgtttcaggattgttgcataaaggaatgaacgaagtggttgctatctacgaaaaccggggacatgctcatggttaccgtccgatggaagagttgagcggactccggcaagccggtttcggtcgtaaacagacgggaattttgccggtagaggaatgggaagtaagaaccattgataaagaggaaccgctgtctgccttgcttgccgaagaaacgggctgggaaagaatacggctcgatcaacggaccattgacaatctggccactttgcagatagccggacttgaaaagccggaatggcctgctgcctggattttgcaggagaaggccggaagtgcagtttatcgtacacaccttaggtggacaccggagatgattcgggaaggaatgactgttctggaatttggctgtatcgatgatgccggaactttgtgggtgaatggtaaggaagtgggtacgcacgaagaatgggataagccttatgtagtgaatgttgctccattcgtcaaacctggcgacaatgagatagctattgtggtgagtaaccagagtggggcaggaggcctccttaaggctgtccgcctgaaacaggaattcgaagtgattaaaaaaataaactgggaggtctctgccgatctgggaggaatctgtcagggctggaacagagaaccggatagtacggagggctggtcggtagcagagcttcctgcagattatcctttagtccgtaaaggaaggattacagaaactcttgaagccggtgtcggacgggatgcattgcttacctggtatcgtcttgagtttgatatgccccggaatgatccttctgtccggataccttggaagttgatagtaaatgctatgggtaccggttatatgtggctgaacggacataacatcggacgctattgggaggagggtccgcaacgggagttctatcttccggaatgctggctacgtcccggtgaaaagaatgtgatagtgttgggattgcgccaatctgaaaataaaggtgcccgtttgtttggggcagaagtggctccttatgttgaagatgctgaatgtatccaataaaaaaagtacaaagatgaaaagagttttttatattatgatcgcattggtgctgcctttttgcagtgtcggtgcacaaacttcggtgtggaacccggataatggaaacgggacatttacaaatcctataatgtggggagactggcctgatcccgatgtcattcgagtaggggatgatttttattttgtttctaccagtatgcactatgttcccggttgccctattgctacctcaaaggatcttgtaaactgggagatggccggatatgcggtagagcgttatgatgagcatccctgctatgatttaaaagggggtgaccgttatcttcggggatcgtgggcggctaccattcgtcatcacaatggtaagttttatgtgggcttctgcaccccttcatgggagggggaaggtcccggacacttctcaatctgtattgccgatgatgtgaaaggtccttgggagcgtacaatctttcctgaatatctgtacgatcccggattactgtttgatgatgacggaaaagtttatgtcgtccacggacagggtacgctttatgtcacggagctgaatgcggatgccaaatctgtgaaaggagaaaaagtgaaaatctgggaaaagaggttcaagaacgctcacgagtttggaggaggatatggtatggaaggtgcacacgtctataagataaacgggaagtattatatcacttgcccggcaggcggaaccgaaggctggcagatttgtttgcgttccgacaatatctatggtccttacgaacataaattaattatgaatgattgtagctcttatcctcccaacggtttgcatcagggagggatggtacagcttaagaatggtgattggtggtttatcattatgcaggacagagggcccatcggacgtgttccccatctggttcctgtagagtgggtagacggatggcccatgttggggcgaaatggtaaagatgccattacgtatccgaaaccggaagtaggtaaagcatatccgtttgcttctcctgctacaacggacgaatttaatactcccgtactcgggctgcaatggcagtggaatcataatccggacaatacccgatggtccttgaaggaacggaaaggctacatgaggctgaaagcttcatatgccgactcattgaaaacagctcgtaatacattgacacagcgtgtgcaggggccttcgtccgaggcaacggtcgaaatcgacgtgtccggactaaaggatggaaatgtggcaggatttggaattttcgagtttccttatgcctatgtcggtgtggaacagtcggagggtataaaaagaatcgtgatgtgtaatgacggtaagaatattgaggtcatcgacaactttacgggaaataaattgtgggtacgtgcccgtgtgatggatgtgaacttccgtgctactttctattatagccttgatgggaaaacattcattccgataggtaatgatcttaatatggggcttgggctggtctggacagccaatcgctttgctttatttaattttaccagagataaagccggtgaagacggatatgccgactttaactggttccgttttaccaataaataagaatcaattattgggttgagaatagagatataaaaggaggtgtatcgaaactcgtattcaccacaggttacacaggatttacacaaataaatatcattagctatcgatagattaagctcgttctgtggaactctgtggtgaattatgctttctccgtcttgtattccgatctactatccgaagcatttattatccaccggatataagaattacaaggttacgggaattaaagcaggggggtgcctgttttaccaaaatttattctgttcggcattgtattcaaatccggccgattccagtttgccaatcagtgtttctttattgacattcatatcgtcacatagttcatcgagcgatttgtaacaatcgcggagtttcatgttgatgacgctgaacaacatcatcggatcttctggaagttccataatcattcttttttaaacggctgcaaagatacggtaactctgtttattctgcaagaagagcccttgtttattagaaccatgaaaggcatcggtctttatttatcaaaatagtggcataatatcggattacctactgtagtcaatatgggttctttagacacctcacctgtctgtatgtccagagagtagatacctttcgctttagtcgaagagttacctatcagcacagttcctttgtagagggcaagcatgactccgaaaccattggaaaggtcgagtcccttgatctttttcatggaccggtcgtataggtttatttctacagcgagatcggcgatggcggtatgtccttgttctccaggcttgtagtaaccgggcatattgatataagcatatgcttttccattgtttacataccggatggcagagataaatcccgcagttttttcttctccgctgatgtcagctcccgtaatggtccagcgatacgttgggtcgaactcagtctctcctgccttgatacgcaatatgccggcattatgacctttgaccatgccaaaggcaccgacacacgaaatatagatatcctttttttcatccatgaagattgaatagcggtcaatcggacgggtaggcatggagataccactggttttgtctgtaatcattttcagtagtttatccgtttgagtgtctataatggcaatgtcgctgtatggacggtcctgtggaggaacccatccgcccaccatctggctgaggcctacgtataaaagtccgtcgcgcaacaacatggcagaggggtccggattattgtcggacactccgagagaagacagatcgatctctcccttctggaccatggtgatagggttgaaaatagcgatcctgcccagtcccgccatagataggtaggctttttcagcagaagcgaaaacaatattggtggccgaagagttgggaggcaatttcattgttcctgtctttgataaccggccgttgactcttgtgtatttcaccagttcgtttttactgtcacccatgtatcccgggaatacaaagatgtcgtttccttcaataaccggatatgctcctccgtagggaatgggaattccgttgttattgttggtattctgcggaaattcatcacggatcagctgcaggtaagcggctcccgtcataccatcggggttgggcagaatagttgccagggcgatgttagcattgttggctgggactttagggtcaggatccttttcgcatgctgaaaatacaagtgcagtaccggcaagtgccagtgtcagatttctaatcttcatagttctcttggttttttaataaataatcttgtttcatttcaatacatatctcagccttactccccaattgcgtctgggtagaggacggttgaattcggacatcatccgggcattagtcagattgtttatccgtgctgtgatgatgaaccgtccgttcatgaagctatgctctattccgacgttggcagagaaggtgcgtggtattcttcgctcttggaaccggctttgttcaaagtcgtagaaatactcttcaacgaaagaaccgtccgtaaagatgcgggtattctgcattttgcctccgaatagattttctttatgaaattccagtccggcgtttgccagaagataggggatgttaggcatccggctacctttggtcgggttggggacatgagtgttcggttcgaactttcgtacatcccgcaaatcctggtaggtcatgttgcagtagccgtaaagccagtgggtaaggtccgctttcacctctacttctgctcccaaagtgcgcatttttccgaaattctggtattgcgattgcagataacctccggtaaaccgtatcatattctcgagatacccataaaaagtgttcaattccagttgaagattactggcagactttccggtacggtcgaacaggaaccccagattgatgcttgtgttccgttccgggagcagatttccggaaggagcgactgcatatccatcgcccaaaagttcactttcggcaggcaggcgtacgtcatatccaaccgaaaacttacccatgaagtccggagtgaatctgtaacggagggcattgctgataccgaaatcccgtttcagcatgtctactttttctgcttccgatgacataatgctgctcatgtgagtattcatgccgtatgtataatacttcacgttaagtgagttcaggaaaatatcattgttcgtgcggaaatcgtatcctattccggcaatccaactcatcatcgtacttttgaagttggttttataaccgacaactttgtccttcaggtcatccttaggatgtccggaggcataactgaacagtgagttgaagttaacagaatggttgttgttgataacgtagttcaggtgtaacttgtgggtgattgtatgtttctcgtttctggcgtttgaagcccatttgcctatttcccctccatattcggatacggcggggtaagtggtaccgtcccaattgtaccgatatgcggcggtatccaccatatgaaataccgtataagcataggccagattcgattccatatcgagcccctcgacaagaaagttttctttctccaacttgttggcaaagaggaaagcgtcagagtaagtgtgggctttttcaatattatattcgattccttggatttctttgaaagtgtgcataaagacaggttcaaactcaatcaggtcgaaccaccatttacgtgctttcagactacctgcaacagctaactttttaaatttatcgtggttgcgtttaatgacaagcccctcttcgaagggagattccatcttatagttgttgtcagaataggtatagaatcccccgcctccgaattccagtcctttagaagcgatattccgtttggttaccagtgaaagcttgtgggtattgaaactttcgatgctgtagctgacatcgaggtacttgggcggatactccctgatgacaatgtttacagctccgcctacggacgatccgccaaaccttgcgggtaccactcctttgtagatttcaattcggtcgatcatctccacgggtatgtcattaatgtcgatgaagtccgaattatcattcatcgggcttccgtcaatgaagaaaccgattcgtttcccctccagaccgcgtaccgatacccgggacgcactgcctacacctcctgtgttacggatggttacacctacggttttcgacaagacatcttgcacattactgaccgtcccctgtagttgttgcatgctgattactgacataggcatggcctgctcgcgcagttggcgggcttcacttttggctgtgatgacaacttcacccagtgactgagtttccggttccaggcggataaccagctttttacctttggtattcggaatcgttatttcctctttccgggtgtgatatcccataaacgaaaaagtgaccgaataacgtcccgcaggagcttcgatgaggaactccccgtttttatccgccgagacgcctttcttcagtgcttctatatatatgttggcacccgggagtatttcctcgtcattggtgtcgatgatgactccgctcagtttgcccggttgtgtttgggccgggaggccgctgcacagtgagagcagagtgatgatgaaaacacagattttatttctcatatcctgttctccttatttagatgattgttgttggaacttcatgtgtactatccgggacgatttccgtaaagatgggaatagtgggagcatcactttgaagaacagaggccatcgtttttttaagcggtccatatacaggtattccttaatcacgtgtagccccggataccagtcttccatctcatatacgttgtctgttccccatcggaatggtgcgttatacttctttacgtccggatgccatttgtagttacgggctgtccatgcattaattacgtcgaatgccatttccgcatggtggaagcgttgcccgatccggtaaattaactctctgatatcttcttctttgaagtacatcatcactccttccgatatgatcagcagaggaagacctctgggaacagagttcatccatgaatcatcgaacatcgaccgggcgatcattttataattatctgtttccttgaagaaaagttttcgtaacccgatggattcttctacgtcaatgtctaaccaaaggcaattgtgcaatggaagtcttttgcagcgtgcatccagtccgcatcccagatttacgacggtagctcccttagagtgtttcgacaggaagtcgaggatgatttcgtccaatacgagggtacgggcaattgtgcccacctgcgaaccttccgaaactttgtctttcgaagaacttgccagttcgattcggtggagtatatctatggcataagggtctttgatagcgccgttgggttttactgtttctatagcccttattcgcaaggttataaacagagtttcgggaactcctgataaatttactttcatgtttagtttctgcttttatatttccggttgttgtttattattcgtggagaattacctattaatggggattgtgccgataggtggcttattgtaattttgtatctactctccaattggagacaaaagtagagccttaccagcttttactgcttacgcgaaaaggaacttgactttaacttaaaggaataatgatggcaactcggttaatgaaacatgatttgcatgaaatgatgctggaatggcccgtacagaatctggcgggagagagccggacagaaagaaatagttatcggattgacaatgggtatctgaaggcgacattcgaagaaatatgtactccgtttttttcgataatggaacatcatatatcatgtgaggagtccattgagatgtatgcacaggccgatgaataccatgctgtttggttttgtgccgctttagccgggcacgtcacttgcttttacgaccctattacccggagtgaggagtggaacaaaggagatgccaatctcctgcaatgtgacgggatagactcatgcgcctgtttccctaagcatacgccgtttcacatgatggagattatgctttccaacgattatatccgtgaacttgccggacaatatcccgacctgtttggtaatgaagatatcgaaaccattttttgtgatagactctacagggcatatcggacaaatcgccctttttgtactggtatttataaagcgttgagcgatattaagctttcacagctgaatgggaatatggcacttatgtatgtggatgccaagattagggaaattctttcgctttttctcgcacggcggggaggagaagagtgtcttcattgttcgtgttctgtcgggatagagtgtgataagatccatcatgccaaggccattattgagcaggagtatctcaatcccccttcgcttcatcagttggcattgcgggtaggtaccaacgaatgtactttaaaacgaggtttcaaaacggtatttggtaccaccgtgttcggccatatatttgattatcgtatggagatggcctgtcgttatctgctggatagcagtaagacgatacaagagatcggggcatgtgtcggttatgaatatcatgcccatttctctacggccttcaaacggaagttcggactgacccctctggaatacaggtgcagccgtttgggcgcctcctgaggtgacgacgggattgccgtccgacggaataaatggcaaaagcgtttgagaaaaacttcctttatcagcagatttacacgataatatcattgggataaatccgtatatgaagtctggtctgtgaaagtttgcgcgggttttgctccctttgcttgttcagactttgacggcagaaacagccagcatcataggccgtctcaattcttcttccatatccttgatcttttgcagcatctctttagtcggttgaggctctatcacattggttatggtaaatccggcctgcaatagtccctgcaatatggaagttaaagtatgatggaatttcactaccgtttctcccaagaaagaggtttcccggtatccttcagtgaaataatgatctaccggccagtgctgtgcggttcctgctgtgttgtaaaaccaatcttcggttccatgtgccgtaaatatcggatgttccattgtaaacacgaatgttcctccttgggctaatgtacggtacacctttcggaatatctcttctaaattttcaatgtagtgtaaagccagtgaactgacaactacatcaaagcgattcgacggataatcatagtcttctatccctatccggtgatattctattttgtcggactccttctttttttcagcctcttgtagcattttctcagacaaatcaataccaaccacatggcttgctcctttagaagctgcatacatgcagtgccatccatagccacatcccaaatcaagtgtccgtttcccttcaaaatcaggtaatatcttttccagtgtcggccattctcccgcacctttcaacccttcttttgagcgtagcatctcgccatatttctcaaagaaggattctttatcgtaaacattctccttcataaattattaatcgtttctgtttatatatcttgccctgcatttcacctatgcattaaccgctgaaggggcaaaagtacgaaagataatctgctgattatcggaatagatcgtatttttgtgccgatatccactttgcttttctttgatcctgagaattttctataaagttattaacaggataaattgttgatatataggtggtatctctttttaaataggctttgtgaacaacttcatagagagtcgttgcctgctttgagacatctttttggattcgttgttggtgggaacttgtcaatggctttaaatacactcatagcgaagttagatactaaatccagaagcacttcgactaaagttcttttcatccctttggaaagtagctttcttcacctggatttaagttactttctttctctgtttttcatttaatgctttagtactttggaagaggtagtatcttatttaagaacttgcttcttagcttccttttcactacagagtatacagagagaatcccttttatctttcttattgaacagcttttgaacgaagttattaacaggataattgtctggctatctgtggtttgttttgtagtaagcaggttttatgaacaggtgtaaataaggaacttgttgataactgggagaggggtattaataaaacagcctcagaattgattctgaggctgtttgagtgatccgcctgggattctccttacagagttaccacgctgatatttaaaactttatatttttggcttcaagcatatcccatgatttatcccactaatttactacgtgcttttgcggtagtttgctcatggagaatactgagagcaaagatagcttcttttagtaactcttcaaaatatatgatgccattttttaatgtatcataaaaatatgatacattctcggcttgtttatatttctaaaatccgtgttgtagataaattctaataaaaaatgatctacactgtgcttaatttataacttttatagtatatttgcttgtattagttatatgcttttgatgaaaagaacaaaaacagaatttatagtgctaaaagcttttaacggggattgtatcctcgttaagacttttacatctgagcaggaagaatttattgtattagtagatggtggtactgcctctacatttgatcgttatctgaaacatgaactgaaagaaattaaaaaaatagatttactcgttttgacacatattgattctgatcatattggtggattattgagattattcaacaactcactaattaatgagttggatattgtagaaatttggattaattatcccaatcttataaacgttaatctgagcggacaaatagggtttgatcaggcaaataaattgaaggatttaattttgcaaaagaagggcaatgtggtatttaaagaaataacgacagccgagagattcattaataggtctggggtgagctttacaatcttatctccgacacaaaaaatattagatttattgtatgagaggtgggattttggtaagaatgaacccgaggtagatattgatatagcatcagattttaacacttatacagtttctctggaagaattaagtaaattaccttttaagccagataaaactgtggaacaggatcttgtaaatgcttcttctatttcgtttattatctcatgtcctgatataaatattttacttttgggcgattctaggtcggaaattatagagcaagaattaaaaaaacttgggtataacgaagaaagtccttttgtgtgtgattatgtaaaagtatctcatcatggaagtaagaataatacttccgaatacttattgaaattattaaaaactacaaattatataatatcaacaaatggtggttcttctaaaactaaacatccttcaagagatgttattggaaaaattatttttaatccacgacgagaattaaacgaattattgtttatatttgtaaattatcctatttctgaaataaaaaatcggatcggtaattttattgctgaagatgatatggagagtggtaactggaaaatagaacataaaaataaattctaggaattaaaatgccatataaactgatagaaaaaaccagtgtaagaatacgggtgaagaatggagaatctatcatcaaacaagggagtggagttattatcacttttagtagtgaatattatgttttaactgcattccattgtttaggattagaaaaaaattctgatatattaccagatataaaagatgttattgtcgaaagacaaacaaattatatatcttcttttatccctataaaagtgatttctattcataaaatgaatcgaaatgatgattttatattgataaagattgaacttgtagatgaagatataaaaaaatgtggattaggtcataatccaaccgaagaacgtaaagttcgtttttgtggctatcaacatattcatgcatcacaatacagaccgtttgatgggaagataactgtggtgtccccgtctaagtttcaaataaaactaatggatgatacttttcaacaaaatggggaagatggtagtcatgttgcagaggggctttctggaagtggtgtctatgtcataattaataataaaccctatttgattggaatattatgttctgttaaggatacgcaggcttggaatgatgatatagattgttgtgctttaagtaaatgtttatctaatattagttgtcaaatggaggacttatctgacttaaatcatattaaagcatggtctgaaaatttagagagagaaaaagcgcaagaagatatagataactacaaatcattaaatattgagttttttgaaaatctccttaggaagaatatggttattcatgatactcaggaaaaagcaattaatgttacaaataaagagctgaaaaaatatttatcattaaaagaaaatgtaagtctactagaatcacaatatccatatatatacaaaagatttcaaaatgtagtaaaaaaatttcaagatgatgtagaggatcaatactctagaagtgtaagagataataatgaagcaaaagataagagattagaacttaaagataaattgaaagaagaacttgaaaacatcttggaaactggtgatatgaaaaatgatggaataaagtttgacttggcagattatcaggtaattgaatggctgctagattgttcactaaattttactagaaaaaataatgattgatattaaacttataaataaacctatatcggttccaataagatataacgcatattataaactagttttattattagcaattatagaacattgtgcaatgggcaaacaggcttctttgcaactaatacattttgtcttttggggcttgagaagcgaagataattataaaatagtatatgacttttcaaaaaagattagagaaacattgcctccttggtcttttgaggaggggatagataaaattctaattctttcatatataaatcaatattgtaaaaaaaaattagttaaaaatacagatacgttggaggttgaaataacagaaaatggggagaaagttatagccgagataaaaaaactggaattgtttaaagaggactttgataaaattaaggctctttcaaaaatagcgagaagtaggcttgataaagctaatcaacaatggataattttttaatattatatttatgcttaatataaacagagtacgagtagagattctttctaacaagagcaatgatatttccgatttgtatggatttgattactctttcacctcaggtttaaatattattgcaggacaaaactctcgaggtaagacaactattaattcttgcatatattatggcttaggtatggaagaactattaggaggtcaaaatgataaggcattagataaagcactcaaagaagaatttacaataatttcagactctaatgaagtcgatcatgagattgtcttgtctaaagtgtatcttgaaatatctaataataaagatgtaaaaacactgctgagatatataaagagccgagtaaaggaagagcctaacaacataattaaagtattcaattccagcattgatactatttctgatgatataaccgaaattgaacgtttatatgtgaatggacggggaaataatgagaatgaaaatgggttctattcgtggctagctgattttgttggtcttgaaataccaattgttagtaatacttctaggattaataattatagtccactgtatttacaggttatattttctactttattaattgaacaaacaaagggttggtctgacttttttgcaacaatgccgttttttggaattcctaaggctaaagaaaaaaatgttgagtttttattaggtttgaatgagttaaaactgtctacagaaagagatgtgctatcaaaagaaaagaatattatagaaagtcaatggaaagagatcttgaatagtttgaaacttattgaaaaagaatataatggttatttatcggatattcctgaagaattaaccacagatcattctgaaatcgaaagaattagtatcttttttaaaacctcacaaaatgaccgtttaagtcttgaatcctatctggttcttttggaagaagaatatgctaaattagatagagctcctatttctaaaatcggaagtaatagagaggctttattgacagagtataaagaacagaaaactcaatattatgaattaaaaatttatattgaaaattttatcagcaaattaaatattgaaaaatgtcaactaaataatttgcaaaaacagctaaaaagaattgaaatcgaaattagagaacatgagtctttgaaaaaagtttttaaatcaaatatattaaatgaaaaaggaggacatttttgcccaatgtgtactcaaagtgtttctgttgacttaataacagaaaataatcttgaaatacctaaacttggcttggacgaaaatacagcttttttgaaaagtcaaaaaaaattgcttgaagcttctattaaatctttaacaaatactataaaagaaaaagaagtaatattggaatattttaatagaaacctacgacaaaaggaagaggtaataaagtcactttctaaagatttaattgccgatgatagagctttttcagaggcagatgttgtaaaaaaaatgcagatacaaagagaggctaacaatcttaaatttatccaatcagaaataaaaaaatacaaagatgaattgataaatcaagcaaataaatttcacaataatttaataaatcttggtgggttaaaagagtctgaagctaaagatgagaatattataaaagcttttgagacttattacaaggagctattgtctcttttcggatatgaaagtaatcctgtttggaaaatagacataagcagaaaacatccatttaagtatttcccaatttataagaattatgccgaagataagacaccgcaatcaataaggataaactcttctgcatctgactttgtgagaaatctttgggcatattctatttctctgttaataaaaggtgtaaatcatccaggtttattagtttttgatgaacctggacagcatagaattaatatacaaagtttgaaatcgttatttgaattttgttcaaacatagcaaataaacaaattataatatttacatcaatagaaaagccaattagtgacaaagaaaaattggaaatagatgaattaattaccaatattaaacgcgaaaaaatccatttaataaaattggataataaaaataaggttatacaacttctcagctaattttaattgatattttataatgcagtaaataggtaagcctagtattaggtttacttatttacgttatatcaaattgtgtttcaaaaaaaattatagtttacgttttttcttttttttacgattataaaactgcttttcaggattagcgggagaatccatttctgatgatataaaagatatgagtgaaggagatgtatgatattcttttagaggaaaggatggtttaataaagactttatctttttctttgatggcaatattgttatctaaattgaaagcaagattgtttgtttccttgttttcatgatagatagaaaatatgttttcttgattgttgttctgacttatttctgcttctctttcacttgattgaaattcctgtccttgtagtttaacttctctagatatagaatcatttttcattgtattatggtaattaaaagattcagcttgttgacgtttgtagttgaatagtttatcaaatccttgttctgtctgttgaaataagtttgcacggttaaatccacctttaattatccctttcttggtatttttatgattagtcagtggtgacagcttcttcttatttgattggtctttcctacttactagcaaatggcagtgcatattcagtttattgtgtgaacggctacggtcaaaatgaatcttaccatagaactttatatccgaagcggatagctttttattgaaattcttagcatattcaggaataaatacttcacgaatatatcgtttcatagcttcggctttctcttgctcggtgttacccattgcccgaagttcgttttccgatgggctgacgtggatagcgaaaaacttagcatcagttttcagtagttgcccgatattactatctatatctttaatcacctttgatttgtagatattatcatccgtcaggttgaaaaagccatcggtatagattcctttctccatccgttccaaatcttcatgttccatgtaattggctatctgtcggctacttccaccattattatatgttccgtttgatggtggggcaaagtctatgtgcataatcttatgtgtttatcagattgctgatttcagctttcaggttctctttccttttattatccatcacgccacaagcagaaagttctgaatagagttgtattaaatggagtaactttttatagtccctttggtgtatctggtaaagtgcgttaatctgtttagactggttatttatcacatcggcatgattgccgaactgctcacttagctttttaagcacggctgtttgtctctcctgactggctcccagttgagagagaattagattttccaaagttttgccgatagcatcgaaacgtaaagcgatagagtttgtagctcgtatcatggggttcagttgtttttcttcgtagtgacggatgaagcggataatgtcatcctgcctcttatttattttcgccagttccgattttacagattcaggtgcttcggatgggttaatatgtgccttatcgatatacccaaacgccaactttacaacttcactttttttcagtgaatagcgtttgcatatcttctctaccaaagctgccgtttccttgtctatggaaatggtagtgaatatcgttttccgactgttgtttggcatggtaattacttttttatagaaatgtgaatagataaatacctgataataagcattacaaagaaaatacttattacaggtgtcattacagcgtgttcttgtaacacgctaaagccgaaggctttgccccgcagggcaagagggaagaacaggacttgtccagttccctcttgctcgatttagtgaaacgggctgaacccataggtgaagcggtttctgctaaatcggggtggtaacacaaagtgatagcttaaacacaagcttctctcctctgctgcattttgctgtcagggtttgttttttaattgattggctttttcaaactgtttataagtctgataatcggctcgttcacgtacaaaagctctaatatcgctagcccgatagtaggttttatgcccaatagtaaagtaagggagcttaccttttagtcgatagcgttgtaaagttctgaaagacacttttaatagaaatgctaaatcctgattatcaagtaatcgttcattttcttctaatacctgatcggtattgataagggattttaagtcttgtcctatctcagtgagtttcttagatagcttctccatccatttatcgaagttttcgttgtctatatacattttgcttcattttttagtttaacattattgttctcaatcgattgatgaagcaaaattcagtaaaacaatgtaacagaaaaagaggagtagttacctactccccgaaaagagaacttcaaatctctggaaattaatagtttacacaagtatcttttttgatctttatcggttcttacgttttcgatcctctttgatgatagcatttcgtaaggcatccaatgttttggtaaggttgtacgacttgcgggtaaatacttcacctaccttatcgtaaatacttccgaattttagattgaaaagctgctcaaagccacgagctaaacgaacttctgggacaggttttccatcttcgccaacgatttgcccctgtaaaaacagagctaatacgatttctgcaatgccaataatccccaagtcttttgacttagggattacatataggtcggacttgaacgctgtaggaatagataacttaaattgttctggatggttaattttcaagttgattaattgtaactcggcatcaattgtcgataacgctttatggacatagagaattttaagcgcatttttccccctgcccacattgatataactcttctaggggtgctatctcaatacgggtgagatttagcatccgaaagatataggaataatcttctgaattgctaattgtgactatgtgcttgacaaattctccataagcatcttgcatctctgtgttagtaacttcttgtgaagttttagacaatagctcaaaaaacttcattttcaataactcattcataagcataatttttagatagtgaataatattaattcgtataatcgtaaattcaatatgcttatttagggggctatatttttatatattcggtattaatagtatcgattttagaagaaactatatttttgtgctgtatctattatataatatgtaaatcagtccgccagaaagaaagatcgttggtagaataaaccaatagttattacttattagaaacttggctatccaaaaagaagggagaaatgaaaatatatattgggtactatctgtaataacaaaaggtattattaatcccaccataactaaagcagatacttttgcaagtgccataccttctactttattccccgcatatgccaaaataatcatagcagccacaacgcttagtattgtagccaatattgatattataaatgtagtccataatgacatatctgatacagaacaaaaagaaagcagtacgaaagaaacaatggctgcaaataaaacaggaataagcaatcttgatataagataacccttcttaccaagtggggtgattgtgatatacctgttgattttcatgtccgtttcatctaataccactaagaccgaagcgaagcaaatcatgtaaggacacataattgcaaggaataaatccaatatcggataatataggctgaaatcctttagcatcggataatgctgtacaattaaagggaaaacaaacctatatattgccgctaatattagcgggatacatattattgcagataacataccatctgagaatatgtttctgataaacattttgaaggaaataatattctgattcataattatatcgtcatcattttttttactgacagacaagaaaaaatatacattgcaatacaccaaatgcttattgctattagagatatgacactgatatttccagacataagttctataagacttatacttggatgtaatagcatagctcccgatttatagcccattgtataaacagatatgggagctacagatattattaaagtgggaaccataatcagcataaaattattcatggttgaaataaaagcagaaagtgatattccaaccagtgtgaataatgctgaacctaacataattccaacagcaagatgtatgtaagaatgttccatgcctgagaacaatgcgatgagaactccacttagcaaagaaattagtccaatggaaattacctttgacaaaatgtatgcgtgtatcgatatgggcgaaacagctaatgcctgcattactttttcgcttttctcgaataatattattgctcccataaacattaatccgatcagtacgggatctgaaaatataagggtagttgtacatagttctttccacggcataggaagaatgcgcaatactgtaatatacactagtgtaaataacgtatatagggcataaaaaccatatttgtattgttgccgaatatcgcctagtattaaacctttaagcttcatagtaatttcctccctgttatttctgagaatatattgtctaatgttggctcattgctatgtattgataataaggcattagcttgaattagagattgtagctttttatctgtacttattttgtcaagtgcgattgtagtatttaattctttttgattctccaaatatgaatatgttacttcattataacgccttgacatgataagattatgaggagtgtccatagctttaatgttgccatcaacaataaatgctacacgatcacaaagttcggttgcatcgtgcatattgtgagtagtcagaatgattgttactcctttatttttaagatcaagaataatgtttttcatcacttgggagtttgaaggatctaaaccagatgttggctcatccaaaaataacactttgggctgatgaataattgaccgggcaaagtttaatctggatttcatacctttagaaaaacctgctactttcttgttggcatgttgtgatagtccaaccatttctaataattgttctacaggaatcagcttacagtcatataaagaaccaaagaattttaagttctccaatgcggtgaatttctcataaaaactagggaattcaaaatcgacaccaatactctcatagaactggtcagacttatttctaatttcattattattaatagaaacactccccttatatttagggagcatacctattaatatcttttgaagagtgctttttcctgctccagaaggtcctaagaagccaaatatttctccgcttcttacttgaaaattcatattctcaataaatggtagttgagaataactaaacgataagttttttactgtaatcataattttttaattttatatcgtatgactaaaattgtttatatagtcatattgtaaattcaaagtatcgctatgtaacatatctgcacatagtcagttgatattatataatcttgttgtattggattagtctttaaatagttgctgtactattcccctaactataaacttgaaaacctcattgtaaatatctgttccaattgttttctcgtttagaatagtcaagaatgcagctcttaaagcccctgcaaatacttttgtatcaattgatttactttctggaataaatttcagtagttcgtttgctagcatgacatcatcatctacgtgttttgaaagtacttcttgagggagctttctatttagatattccacatcactattaacgaagatagatacaaagtatggtttgttgttgattagcaagtcagatataatatctgtcaatgtatcaaccgtaatattattggtatgcttatttatggcattaagaaattctttttccaatttcttatgatagtctattattgtatcgaaaaaaagaagttcttttgatgtatagaatagataaaatgctcctttagaaatattggcatatttaacaagctcatctacagaagttttacgtaccccttgttgctggataaatagcaaagctccttctttgagtttatcctttataagctttctttcgttgtcatcaaatgcttttgccataccgtgtgactattttgttattattggtcactgcaaacataagcgttatttttgaattgacaaagaaatatcggtttatttttctttgtttctatatgatctgcctaaatcaatgagtatttcgtctataaatcattgtattatgttgccacgataagtacatattaagtcattaagaactttacttcgccactttcggacagttttgaaaacggctcatgattcttcttttatttgccgatgaaaataaaatcgacatgttttataaaccttttaaaattgaaagtatggaagtagtaactattgaaaagagaaccttttcgtatgtctgcgagaggttcacggagtttgccaaacggatagaaagtttgtgcagcactcatacccagaaagtcgaaaactggctggatagtcaggaagtgtgcctgttgttaggcgttagtaagcgaactttgcagtattacagaagtagcggaagattggcttattctcaaattggtagtaagatttattataagccttccgatattgaaagaattattgcagacagtgaaacgcaaaatcaatcacccaaacaccccacgtcttatgaaaagaattaaaaaagattatccgtttttcaacctgttttccattgttggcacatgggaaagcattaatctgaatcctacggttatcatctatcggaatgataaagagtaccttctttctattatatatgtatcggaaactaccaaacaggcttcacccgctacttatgagatacaacaagatggtagccagtattttattgccactgcatccaaacggctctatgtagattatgattcggcaaaagatgtacttagcatttcatcgctgggtgactatctgcgtaactagccagctatctagccatcttgaaatcaatatttcaataaaacaatctttcaatcatggaactaataaataaagataccccgcaagttaaagagtttatttcttcgcttgattcgatgctgaacggtattgaatctatagtcaagcattataaaccccacctgaacggggagcgttttctttctaacaatgaagtttccaagaaactgaatgtcagtttgcgaaccctgcaagaatggcgagatacagggctaatcccctttatccagataaaaggtaaaatcatctaccgtcagagtgatattgataaactgctccaaaagcactactttgaaagttggaaagagtaacctgccaagcccaaaaacattgtttttcggaatttaatttgaatcattgacttttccagtgaagtatttagtctgtgcaagtctttagatgaaaatacgctcgaacatagtgagaggaagattttcatctaaaccgaaggctcggacttgaacaggctaaatacggaacttacctttgtcaatgcttcatattgagttctggaaaacttactataaaagaaaagggttgagaaaatgaaattcattcttcctaatcctttttcaatattagctattatttttattatatagccaattccgacaggcagctatttactttttgcatatccttgaaaatattctgatccaatacccttgcatagtgttttgttacgcttgtatctgcatgacctaacatcttagcaacattctccatactcacgccatttgcaaggcaaatgcttgtggcatagctatgacgggcggtatgtgtgctaagatttttatgaattccgcacacatcggcaatctccttcaaataactgttcatgcgttgattacacaatacaggtaaaagttttccggtacattctgccacatatttatacttttcaagtatagaagctgccataggcagcacaggaatgttacacatgattttggtcttttggcggttcttccttatccaaagttcccctttgttatcttttactaagtgttcaggtgataaatctttcacatcgctgaacgccaaacctgtaaaaatgcaaaagacaaaaacgtctcgtacctgttctactcgtttaattgtgaactctttagcaagaatgattttaatttcgtccattgttagaaattcaggatcggtttcttccagtttgaagcggtaataagcaaacggatctttctttatccagtcgttttccaaagcaatacggataatcttcttcaagttcttcagtcgggtgatagctgaattctgcgcacaccctttttcaatcttcaaaaaagcatcgaacttagaaatgaagttggcttccaagttgttcaaagcaatatccgataactgatattctttcttaatgaattcttccaaatatcgggtagtggtttcataccgttgaacagttttgcttacgaagtctttgccgatcagtttacggctttgttcgttatgttccctgaatacctgcaatagtgttttgttatcttcgtccacaccataaaacaactttctcacaagatcaacggtgataatcttgccggaagtttccagttctctataaatttggtgtatgtgtgaacgtgtgatttctaagtagtggttcagttccaccgacatacggtctttaccttttgaattctcttttgcctgattccagaggtttacgggacagcttcttttgatagaaatatctaccatacagccgtttacggtgattctcatgcacacgggtacttctccgttctttaataatttgcctttcttgatgaagaacaatacagaaaatgattttcgagccatttttacatcgtttttaaagttacaaaactatgtattctcttccaaagtaagtctatgcaaaaagctatgaatcagtgagaaagatgcaaattcgtgggacttttttcgactaaattttagtcccacgatttatccaccaataatatgcttgaaacggctattttctgctacctgccagaaaaaaagaaatccctgataatgtctgattatcagggatttgcttgatttttcttgttgtttcagtgatccgcctggggctcgaacccaggaccccaacattaaaagtgttgtgctctacctgctgagctagcgaatcaatccttatttgcgtatcagttatttcctgattgcgggtgcaaaggtagtgactttttttatatctgcaagcttttgggtgaaaaaagtttcatttatttttcgtcatctctttctatcttctgattatcagatatttcatgtgtgtcgtattttattctctctttgttgatgatgaaacgttgataataggagagcattagggtggtgagcgggagtgctatgatcatacctaacattccgagcaaggatccccagatggaaagagataaaagaatgatggcagggttgagccctgtgatctttcccatgattcttgggacaaggaaaccatcttggatggcttgaacaacaataaaaacaacgagggcacctgccaggattacccagaaattctcaccggtatcagcagcttttaggattgctaatatgacggtaggcaagaaaccgataatctgcagatatggaaccatattgagggcaccaatgaaaagtcccaaggcaatagccatcggaaagtcgatgatcaggaacccaatgctgaacaagatgccgacacagaaggcaacaagtgcctggccgcggaaatagcgattcattccatcctgtatgtcattgaccagattggatgcaaaggtacggtatttgcctggtaacaggtgaagccatccttctgcgatggattcatagtcgagcaagatgaataccacatataataaaatgatgaatgaagcgaatacgctaaacagaatattaatagattccgcaacgagtgcccaaagtttaggaacagtctctttaatggtattcattatattttcttcacttaggattcggttcagtgcctgaaggtcgatatgcctgtggataaattccgaaagagtaggaggcactgttccggaacgataagcaccattagtcagataagtaaccaacagatcgttcattcgtcctatttcggcaagcattgggggcactaaaaggtaaaaaatggcaattcctattatggtaatgctgaacaatgcgcagaaaatagaaatgatcctgcttttaaagcgtaatttatactggaaaaatttgacgagcggataaatcatataagcgataagccatgccacaaaaaaaggtagcagtacgccgctgagccttttaaaaagtatcagtaatcccacaatgagcgcacagcagatggaaccacgtatgaaactatcaaatgtaatctttttcctttccataataatctgacgtttgatgtgcgacctcaccgaaaatgtccgggctttgctaccgtgaggtcattatgatttttctttgtcctcttgcagggctttctggtaacatgcccgacataaaggttcgtattcggctgtttcacccaatagcacctgtttgtcgtttttcaccgtacggtgtgaaaaagaggctaattgtccacattttacacaaatggcatgtaccttggatacttcgtcggcaatggcacacaaagctggcatcggaccaaacggtatgcctttgaagtccatgtccaatccggctatgatgacacgtactccgttgtttgccaattgattgcatacatctattaaaccactgtcgaagaactgtgcctcgtcaatgcctaccacatcaatttcggatgtgaaaagcagtatgctggctgaagagtcgatgggggtggaggaaatggtattactgtcatgtgaaacaacgtccccctcagaatagcgtgtgtcaatggcaggtttgaatatctctacgcgttggcgggcaaacttggcccgcttcatgcgacggatcagttcttcggtttttcctgaaaacatggaaccgcaaattacttcaattcttcctcttcttctcgtctcttgtatatgatcttctgaaaataataccatgctgatgtatgttataattggttgcaaaagtaatagttttattggcttctcggtgttttttcattatttatttctacatttgcgaagtcattcaagaagaaattcagatgtagatatgcaagcattgttgaacgatatagaattggatattcaggaacttaaatgcctgatggaggccgtttcgcgtaaaccggactctgctttgcgtgaagtggcaaagagaaatattgtgcaaatgcgtggccggttggacatcttactggaacagttggaccggggagcactaccggaaaacgaacttcctgaccggattataaatccaatgccggaacctgtgtcagcagcagaagcagaagcagcagcagcagcagcagaagaagaagaagaagaagaagaagaagaagaaatagttgtgggtaacccagagaaagatgaagagcctgtaatagttccggaggctccggagatgccggaatctgaacaattggaattgcctgaagtgaccgtagaaccggcacaatcggctgaagtatctatgaagattgaaaccaatacggcttctacacctattttggccgagcggattaaaacagctggagatttacgccgttcaatcagtctgaatgattcgtttcgcttttcccgtgaactgtttgggggaagcatggagcaaatgaatcatgtgttgcaacagattggggagatgcattcactggatgcggctcttgttttcttatcttctaaaataaaggtggaagaggaaaatgaagctaaagctgatttagtggaacttctcaaaaagtactttatataaaaacgcgattattaggatatgggaaaactatatgtggtaccgacgccggtcgggaatttggaggacatgacatttagggctattaaagtcctgaaggaggtcgacttgattctggcggaggatacccgtacttccggaatcttgctgaaacattttgagattaaaaacgcgacgcaatcccaccataagtttaatgaacataaaacggtggagagtgttgttaatagaataaaggcaggagaaaccatcgctttgatttcggatgccggaacaccgggaatttctgatccgggttttctggtagttcgtgaatgtgtgcgcaatggtatcgaagtacaatgcctgcccggggcaacagcttttgttccggcgttggtagcatcgggattgcctaacgaaaagttttgtttcgaaggttttctccctcagaaaaaggggcgtatgacaaaattgaaatcgttggtggatgaacacagaacaatggtgttttatgaatccccacatcgtttgctgaaaacattgacacagtttgccgaatatttcggtcccggacgtcaggtatctgtgtcccgtgaaatttcaaagattcatgaggaaacggttcgcgggactttgagtgaattgatagaacactttaccgttaccgaaccccggggcgagattgtgattgtacttgcaggaatagacgattaataataacttcatttaaaaacgtaaaacgtaatcgtatgaaaaagttagtagttttattagtatgcgcagctatgttggcttcgtgtaacggcctgggtggtggaagtaaggacctgaaggcagaaaatgattctcttttgatggagttgacccagcgcaatgccgaattggacgaaatgatgggtactttcaacgaagttcaggaaggatttcgtagaataaacgcagctgaaagccgtgttgacttgacccgtggcactatctctgagaattctgcaaccgcaaaacaacaaatagcatctgatattgaattcatcacgaaacagatggaagaaaacaaggcacagatcgctaagttgcaggctatgctgaagaatagtaagaataattcggcacaattgaaaaaagccgttgaatctttgactcaggagttggttgctaaaactcagcgtatcgaagaacttcaggctgaattagcttctaagaatatccgtattcaggaattggatgctgcagtaactggactgactgccgataaagagtcattggctgctgaaaatgaagccaaggcaaagaccgtagcagaacaggataaggccatcaatagtgcatggtttgtgtttggtactaaatcggaacttaaatctcagaagattcttgaaaaaggggatgtgctgaagagtgcggatttcaacaaggattattttactcagatcgatatccgtactactaaagagattaaattatattctaaacgtgctgatttgctcactactcatccggctaaatcttacgagctggttaaagatgataaaggtcagctgactttgaagatcacgaatccgaaagaattctggagtgtatctaaatatctggtaatccaggtcaaataagtagtataaaacaaacgtaactgataagggcacggactacacagtatgtaatccgtgctctcttttttgaaatgtacctgatatattaatatgaaatatagaaacctgttttttgatttagatgatactctctgggccttttcccaaaatgcgtatgatacgtttgaagaagtttacgataaatatggattgggaaggtatttcgattcgttttcccatttttattctctttaccaaaagaggaatgcggagttgtgggtagaatatggaaacggggaggtgactaaagaagagttgaatcgacagcgttttttatatcctttgaaagctgttggcgttgacgatgaaatgcttgcaaaacgttattctgacgatttctttttgatagttcctactaaaaggaggctaatgccgtatgcggaagaggtactttcgtatttggcacctaaatataatttgtatattctttcaaatggtttcagggaattgcaatcctgtaaaatgcgttcggcaggcattgatacatattttgataaaataattctttcggaagatctgggagtgatgaagccttggccggaaatttttcattttgctttgtcggctacacaatccgaactacgtgaatcattaatgattggggatagttgggaagctgatattgttggtgcctatggagtgggaatgcatcaggcttattataatgtgtccggacgcactgattttcctttccgtcctacttattcaatgactgatttgaaagagttggtggaactgttgtaacatttatagatatattgtatttttgcgttcaatatagaacgcataaaaatacaactatggacactctcttgccttttgctttactctgtttcacttctttctttacattgactaatccgttgggtacaatgcccgtttttctgaccatgactcatggtatgactgataaagagcggcaagcggttgttcgccgtgccactttcgtctcgtttatcactttaatggtatttgtttttgcagggcaattcctttttaaattcttcggtatttcgaccaacggatttcgtattgcaggtggagtgattattttcaagataggctttgatatgttgcaggcacggtacactccgatgaaattgaaagatgaagagattaaaacctatgctgacgatatttcgatcactccacttgccatacctatgctttgtggtccgggggcgatagctaatgccattgttttgatggaggatgcccataccattgaaatgaaaggaacgttaattggcattattgctttgatctattttattaccttcttgattctgcgtgcgtctacccgattagttaaagtgttgggggagaccggaaataacgtgatgatgcgtttgatgggacttattttgatggtgattgctgttgagtgttttgtcagtggattgcatccgatattggtaggtatcttgaaggaagggttgctataaatcagatactgattcgttcagaaaaagaagaatgcccggatacgttttatatgtaaatccgggcattctctttattgtttgataaatactttagaaagtattatgctgattagcggctaccaccggcccaccaaaccggatcggtatatacatactggccgtttccaaatgcagattctacgttcgggtttgcacttacatcatctgctccgtaaggtgcgcgaagtgggaacttgtaaggattgtccagtttgatatattcctcgcccattgctttgaggcgtcgtacatcattatagcattctgttgtctcaccgaaggctccaaggaatgcaatatatttctgtaccattacctcttttacaggattggcatcgaataatggttttacgttgttggtgaaatactcttctgcttcagcagttgtgatagctttggtagtctctttaacgcctccgtaactttttactgtaggagcgttaagtgcagctgttacacctgtttctgcatttgcaatggctgcaacaatagcatctttcagagcatctgccgcatcattggtcttattcaagcgagccaatgcttcagctttcaggaaaagtaattcatgatagctcattaataaggttggacatgtttgcgaatatacgaatataggagtattatattcatatttaacagactctgccgtaccgttatcggccataaggaatcttgggtcatctgcaccggttacttggatggacacagctttttcttctccagttaccttaccttgtccaatgcaaaagatacggcgtaatctcggatccttacgttctattagtttatcagcgtagcttttacttgcagccaatccgtcacggctccactggaagtcaaataacgggtttaagtttgttgcactataaatagagaaagcagcttgatcctgaatagatgtatatgatttctctatgtactctaaaattttttgtaaatcagcttcttttgaagaagaacgagctaacagacgcattgtataacgagctttcaagccgtatgttagttttaaccatgcttctccgtcacctttatatatgaagtcatactcaccaatttcatcgcttttgtcacctttgggaagatcagtgattgctgcatccaaatattccataatggtagtataaatagcttcttgcttatctaattccggagtcataaactggggttgtccattgactaattccggaagggcagcctggctgaaaggagtgtcaccgaatgagtctgcgatcagtcctgcattgattgcggccaatacttcggcaatacctttggttgtataattggctgaaacctcatttgagcttatgttaattgcgatacgtgcattcttcagtgtagagtataaattaccccatacattgttaaaagtagaagatgccgaaggctctccgttacgcttttccgcatttgccaattgattgtctactccaaccatatgctctacgtaggtagaataatatgtattaaagtcgcctccgatattgctaaatgcagttgcagtgattacgtcagccaagatgaatttggcaggtacactggttgtgtggtctttgtcttcattaatacgatccattgtatcttccgaacaggaagcaaatgcaacggaaatcaatgccacagacaatatgccttttgataaattaaatattgatttcatttttgtcctttttagaatttaactgtaataccaaaaccatagcttgatgttcccgggagcgagaagcgttcgaaagcaccagccatgttgttatttccctgtgatgattcagggtcaataccattatccatttctgaccaaagcaataagttacgtgcaaagacgtttactgttacgcctaagtatgacttatccagtaccggataacttaaagcgatttcgcgtaatttcaggaatgaagaaccgtatactccggcttcagagatcgtactcaatctgtcgaagtaattataagcgttctcaccgctgattttgatgtcattaggtgcgtaagaaccatctgccaactgttttacagccggtttattgaagtagaagtaatcagctttacgatagtctgctgatttctgggttacaccataatagtcgagtgttgacacagtaccggcatacatacatccaccttgcttccagtcaagtactgcagagaggcggaacttataaaattcaaaagtagtattgaagcccagtctgaagtcaggagatacacttcccaacactctgttttcacctaatgtcggcataccgttttcatctacaacaatctggccttcctcgtttctttgatagcttgtaccatagataaccgggaatttatcaccggcactcagacgtacttgcggatcaacaaaacctcctaacatgatgcttgatacacccggagctaatttatcgacatagttgtcgattttagagaaattaaatgcaaaatcccagttgaagttcttagtttggatcggatttacactcaaagtgatttcgtgtgagtttgtatgtaccgatccaccatttgtgatcaattcgctatatccggtagaagtagccaaaggcacctcgaatatctgatcctttacattctggcgtgaatatgtatagttcaatgaaactaaaccgttccagaaactgaagtctgcaccgatttcgtatgatttggtgttctgaggtttcaggttaggatcataaattttgtaatatggaatatatgagctgatcgatccaataggatactggataggagttcctgaagagaatccgccaccatagaccggagttttatagtaagaaggatagtaagtacctgcctgccctacttctgcataagaagcgcgaattttaccataagtcagaacatcattcttcagtgcttccaattcggtaaagatgaaaccaagagaaacggaagggtaagtgaatgaacggttgttgcgtggcatggatgaaacaatatcattacgaacagtagcattcaaatacaacatactacgatatgctaatgaaatgttaccgaagttaccaacggtacgctcgcgatggtaggttcctgtagacgaatagattgatgcgttagctatatggttccatcctgggaaattgaagttatttccgaggttgtatttgtattttgaagaattatcgactaattcattaccatataatacatttaagtcaagttccggagtgattttccagtcataagtaacagttaacaatgaatttatttcattgtttgtaacgctctgctcttcaatgctacctgttccgttggagtgtccatatccccatgtatcggtatagttagtggtataagcatcggtacctaactggtattttacatccagtttatgattttctgtaccgaaatcagtagaatatttagcaaatgcatttccaaaaaaacgttgagtacgttctttaaaagagttattttcaacggcccaataagcaccatcgaaaccgcctgtcgaacgatacgtgttttgtgtataaggatctccatcaatgtgtgatgggataccggctaaatcgtagctggacggtgcaccatatacagttgccaggataccattgttggcaccggtttgctttttgattttagaataaacgaagtttccattgaaaccggtagaccaattcttgttcaattgagcttgtgcagttagttttgcattataacgatccatacctgtagaaggtacaataccgtttgcagtagtacttcctaaagacaaagagtaacttcctttatcgaggctttgtgccacgtttgcactgctgttccacgttacacctgtattaaagaaatctttagcattgtcatatgcacgaggagtggcccatgggtccagtcctgctttggcacgctggtctacatagtattgcccctgatgtttaccgtatttctgagtataggtattatccgtattaccaccatattggggatcgttagccagttctgagatcaaagggccccaagaacgagaatctgatgggctaaaagcaccattaaatccttgtgcgaattctttttggaaatccggcatagtagaaaccttatcgaatgataaaccagtgttgatggtaacttccggtttacctttacgtgcacctttaccgctcttggtagtgattactaccacaccatttgatgcgcgcataccatacagagcagaagcagcttgacctttcaggatgttgatgctttcaatgtcattcgggtcgatatctaccgcacggtttgcatagtcagagcctgtaacagagttgaaagtatccaagtctgtagatgatgagataggcataccatccacaacatacaggggagtgttatctcctgtaaacgagcgtgatccgcgaatagtcattttggaagaggcacccggcatacctgatgacggtgagatctctactcctgaaactttaccttgtaaagcgctggaaaggttactacttgatgcttgagtcagcttatctcctttcacatcctgtacggcataccctaacgcttttttctcttttgagatacccattgctgttactacgacttcgtcaagtgccttagcatcagtctttaatatcactttgattatcggtgcaattgctacctcagcagtctgcataccgatatacgaaatctgcaaagtctttgcagaactgtagtatatactaaaatgcttataatgtgcgtattacacaatgatattgaacttagtaaaaagaaaaaaagatttattaaaacgcttattatcaaaatactacaaatcttctattttattgagaagctcaaaatgaaacacttcatatatcttacaataatcagataatacattgattatcagcatgaataagattctgcattctatttcctattctactacatttttcctttgtactaattgactatttgctttatatagatattttattcacctatcaatagtcgaaatttagagtagtgtcacattcacagatcgcatataagataaatattttttaatgtgtctttcatttgtatcttgaaataaacgacatttttctattgaaaaacagtttgagttacttttggctaatatacaacaaatgtcataatgaaactcaataggaagttccattattgtgaaataaaaaaggccactcccttttaaagaaagcagccttttaattacatgattaatccactattaatatccgggattttgttgagctctcaagtttggatttacatttgtttcatcaacaggaatcggaagtatagctctaaagtaagttcggtcaaagctttgcgattctttaattagtgaataatgataccccttatctgcttcatctttatagcgaacgattgtttcattattgcgtaatgcatcgaagtaacgttgaccttcaccaatcatttcttttcttctttcaagaatgattctttctactgtagcatctgcttccgaaacagccttagctttcggattcgctctcagaacaatttcattcaggtatttagcagctttatcctggtgtcccccaagcttagccgccgcttctgcagcgctcaaatatacttccgaaagacgaagtaaaggcagattatttaaacgcatttcacctacgtcgtccttatcagccgggaatttattaatgaagatttttgcatcgccatattcttctttaagatccttatcatactgagccggcaataccatacctatacgaacatctttaggatcctgactcagcatagccataaagttttttgtaactattgcatccgcatatccgttctcgttcagcaaataagcaataccattacggtcagtccagtcatcattacttgcatttataacttcgaaaatcatttcgttcgtatgtgctccattgcttttataccatgcatttacatattcttcattagtccaaagtttatatggagagttggttataatatcttcagcaactttgagtgcattctcgttatcacctttagtcagatagactctggtaagcaaggcttttgctgcccattcattgatatatccctgagtcttatctttagcaagatatccagaattaatagcgtcagtcaagtctctgatgacttgtgtataaacttctgctactgtatttctggaaggcaaatcatttcgttccaaaggtttcaagataaccgggacacccaaagaagctccgttatcggctgtataaggcataccatagattctcactaagtcaaaatgaaccaatgccctgacaaccaatgcttctgaatatattttacctatttgtgcttctgttgcgtcagtcacctttttttcgttaattgcttgaatcagacgattggcacggcgaactacattataaggtatattccacatattaggagcatcatccacagtatagcgcatctcatagcatgatgacgaacgcataccctgagttctggcttgcatatcctcagcacggacatctccataataaaacatacgggcaccgtaatagctggtgctattagagtttccctgaataccatcatacatacctgtacgtgcagtcagagcatcattatagtttgtaattgcatcttctgatggaattccgtcagcaggttttctatccagccaatcattcccgcaggaagacaaacttaggatagtagcaaccagtgttattgatttatatatctttttcataaattcttttttcataaattgtttctacttgattaaaaaccgatttcaataccaaatgtaacagttcgaagagccggagtctcgaatgtacacaatccgtcaaccggaacttccgggtcaacatacaaactctttttcttccaagttagcaggttgtttcctgaaacataagctcttaatttactgatgcctgctttagacgaccagttttgtggtaaagtgaatcccaaagtcatattcttcacacgtaaatgatctgtagacatcagccaacgcgaagaggctttattagtgttaccgtatgcaaattgtggcaatttggcattatcacctgttttctgccaggtatcttccatcttgtaataagcaggaacattacccacataattataagtacctccattagattgtagccaggtagcataatcataagcatgtccgcccaaagagtaagtcagggttaaattgaaatcaataaacttccaactgatataattggtcaaaccaccttgtactttaggttcgatagaaccgataatcgttttattagcagcagcagaatttgttgttgtttcacggctaccatcttcaccgtttatataatacagctctttacctgtttgaggatcaacacctgcatattcataggcatagatagaataatatggttcacccacacggtggatagaaaccccatcaatgatttcctgttgttcgccatccaacttggtcagcttattcttattatgtcctaagttcaaggaagtagtccagaaaaggtccttgttctggatgttggtagacttcaattccaattcaaaaccacgatttctcattgagccaacattcacaagcatattagcagtacccgcactattgattacaccgactgcagcagaaatcggtttatccattaagagatcttttgtctcacggttataccactcagcagaaatagtcaacctattgagtagtgtaaggtcaataccgatatttgtggcataattcttttcccatttcagattcggattatagaaacgagcttctgacgaaccaccatttccattataattatatccaaattcatatacccccatatatccgtaatagtctttgggctgtgtaccatttacaccgtaagaagcacggatcttagcatcagtaataacattggataatgattccataaatgcttcctgtgaaagtctccatgaacctgatacagaccagaaattgccccaacgactatctcttgataaacgcgaacttccatcacgacggaaactaccacttacataatatcttccggcataatcataattcaaacgtcctaaataggaagtcattcgataactattaatgttactggcacctcttgaaacacctgcatttgtaatctccggtaagtaggatggataagtattaccattagtataggtataatcgtatttgtaatcctccgtttcaaatcccaacagtacatcgatattatggtgttctgcaaatgtcttgttgtaagttaactgagtttgagtattcaacttgcttctgttcatcatatagcgttgaaataccccttttgaagaacgaccatcattggaacgaggatcccaccatacacgattgtttgtctggttaaaatcataacccaaagtttcttttatattcaaattatcccagatattccatgttgcagccaatgtattcaaagtacgcacaattgtactacgatcataattatatgttgcagtctgaagaggattggcaccattcaaagcagggaaactcgtactaaatgtaccatcttcattatatgggaatgtagagggagaagctgtcatagccagacacatgatggggcttgagaaactagtcccttccgagtttactttttgagttgaatttgtaaacatcgtacttgcctcaattgtaacgcggtctgccgtatgactcatatttgcacgtccggtgatacgctcgtatccagactgtagtgtaatgccttcctgtttggtgtatccaaaagaggtatagaatttagtccgctcatttcctccttgagcatttacttcataattttggtgagaaccgtttctgaaaagaatatcttcccaatcagtatatccgctccaaggttttgcagcatatttatcaatattattatctgcatagttcgtggcataagcttcatcctttccagaatttaaagcatagtttttaagacccatatataggatatcgcgtctatcttcaccattcagaatgggacgataatcaatagctttgttggagaatccccagtctgccctcacattgagtttcaattttcctgaagctccctttttagtagtaattacaataacaccgtttgctgcgcgtgaaccgtaaagtgaggcagccgctgcatctttaattaccgtcattgattcgatatcattgctgttgatggtggacaacaagctattacctgactgagaataagtgaattcacttgcgtcaccagtcattacaggtactccatcaatgacatataacggatcattaccggcattaattgaccccattccacgaatacgtacagattcaacagcacccggttgtccggaagtagacgtaatctgtacaccggcaacagaaccggctaatttatcttgtacacttaaagaaggaacatcctgaagtttctccgtcgtaatacttgatgccgctcccgtaaaagatgattttttaaatgtaccatatcctgttacaacgacttcgtccaacacttccgtatcaggttttagcgtaatcttcataacaggcttaattgctacttcaacagtttgcataccaatatacgaaatttgcaaagtctttgcagaactgtagtatttactaaaacgcttataatgtgcatattacgaacagtgcatgaacttggtatacatgtctgttctctatatcaataatttaataatcagtcaaatataaaaatactaagaagccaaagttattatatgttttattatatctccctcataataagcatataagataatgtcaatcagtgttatataagcaataagctttggtcgttattctaccatttcgcttctccaagtaaattccgttttttatatgtacatatttttgatccaaatcctcaaaatatcattttttgttttttaatcactttccagataaaaaataagtttatttttttcctgtattatccttttagattcttgaacgacagatacaaataacaaacccactacaagtagtttcactcgtagtggattcattgtataaattttactactttagattaatatccgatattttgttgatctttcattgctggattggcatctatttcattttgtgggattggtaataaagtcttgtagaaatcacggttaaaactgcgtacttcctcttttaatgcttgttgccatccctgatcttctttagatgtataacgaactatagtttcattattacgcatcgcatcaaaaaaacggtgtccttcgcctatcaattcttttcttctttccaataaaaccctatcaaccgtaacaattgtaccctgcactgtgttagccggattagcacgttttacaatagcatctaaatactttacagctttatcattctgattgcctaatttggcagcagcctcagctgcatttaagtatacttctgacaaacgaagcaacggaacattgttataacgtaaatcacttaacccatctgcaggatatttatttaaaaagactgtatttgtcccatataatttctggaaatccttagttgttggagctaaaaatacacctaagcgtacatccttcggatcttcatttaacaaatcgagaaactttttagttgcaattacgtctgcatatccatcctcattatataggtaggcgataccctcacgatctgtccagtctgtagaaccagtaatggctatttcaaaaagcatttcgttagaatgaactccactgattttgctccatgcggcaacatattcttcattagtccaaagtttatatggagaattggttataatatcttcagcaactttgagtgcattctcgttatcacctttagtcagatagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataatatcttcagcaactttgagtgcattctcgttatcacctttagtcagatagattctggtaagcaaggcttttgctgcccattcattgatatacccctgagtcttatctttagcaagatatcctgagttaatagcatcaaccaagtctttgatagcttgcgtataaacctcttctactgtatttcggggcaatttgctatctgaatccaataccatagtaactacaggaacacccaatgaagcaggtgctccaggagcagtataggttttaccatacacacgtaccaaatcaaaatgtgccatagcccgggctacttttgcttctgctgcatactgagcaatgatatccgctgcttcttccttatcagtcagttttccactttctgctgcttcaataattcggttggcacgtccaataataacataaggcgtttgccagatatcaggtgcattgtccgcagttgaataagtcatgtcataactcagttgagaacggctgccggatttttctgtctgcatatcttcgcctcttacctctccataatataacatacgagcagcataataatcgttgaaatcgctagttcccttaatcatttgatacattccagcacgtacagaagagaggtcagcactcgtagtaacagcttcatctgcttccacctggttgcctggttctacgtccagccaattattgacacacgaagacatgccaaccgttaaagtaatagctattaatgctttatatattgtattcttcatacttattttcttttttaattattaaaaaccaatttctataccgaatgtatacgttcttaatgcaggcatttcgaacgtacacaagccatctacaggcatttccggatcaactaacaagtcctttgatttccaagttagcaagttgttagcagagaaataaactctcgccttggaaattcccattttagataaaagattcttgggtgcagaaaatcctaatgacagatttttcaaacgaagatagtcagtaggcattaaccaacgcgatgaaagtacgcgtgagttcccatatttgaatttaggcaatttagcattatctccctcttttttccacatatcttccaatttatagtatgaaggaatagccccataagatgtataagtgccaccgttgtcatgtaaccaggttgcataatctatggctttaccccctaaagaataagttagtgtcagattaagatcaataaatttccattttaagaaatttgttaatccgccttctactttcggatcatgatgtccaacaatgactttctgagcttcagaagtcagggttgtggtttcattagtgccgttgtttttataatacatttcattacctgttttgggatcgacacctgcatattcgaacatataataggaatagtatggttcacctacacgatgtatcaacgcaccgtctatttcatccgtttggataccatccagtttaaccaatttattcttattatgcccaatgttaaaggtcgttgtccagatcagatcctgagtctgcagattagttgaggataaactaaactcgataccctcattttccagagaacccacattctgcaaagctgtcggagcaaaactgattggatcataataacctggaacataagagatccgtttattcattaacaaatcacttgttttacgtgtataataatccacagttagactcagacgttcccataaagtcacgtctaatccaaggttaaaagctttattcttttcccatttcaaattaggactcccgataccaataattcccatacccgattgtccattataaatttgcccagccctatacatattagtcatataactataataagtactggggtgtgtcccatttaccccatacgacaaacgaagtttaccatcagttattacatttctgatagattccataaatgactcttgcataaatctccaagatccggatacagaccaaaagtctccccaacgattatttcttgctaaacgggaacttccatcacggcggtaactgacccctgcataatacttattatcaaaattataattcacacgccccaaaaaagaagttaaacgcgatttatcacggttactattagaagaggtttctcctgcatttgcaatttcattcttgtaaccaggatattgagaaccatgagtatacacccaaatatccgtgaagtcttctgtttcaaaccccaataaagcgtccaagttatgtttttggccaaatgtcttgatgtaagttagctgggtctgggttgtcaatgtttccagtgtacgattataacgctgaaatactccattggaagaacgtccgtccatactacggggatcccaccatacagattcaattgaagaagtataatcaaaggctattttttcacgtaactttaactcatcccaaagagtaacagtagctgtcaatgtattaaatgaacgtgtaatatcattacgatcataattataagtacgtgtttggaccgggtttgcgccattcgtcaaaggaaaattagaactgaaggttccatcttcattatagggaacgacagaaggtgacgctgtccaaaaagcattcataataggactggcaaaagaagttccttcgttagtcatattctgatgaatacgtgaaaataaagtagaagcttctaatcttacacgtcctgtttcatgagatagatttgcattacctgtcatgcgttctaaacccgaacgttcagtaattccttcttgtttagtgtaagccaaagatgtataaaatttcgtcttctctgttccaccttgagcactgatttcataattctggtgactaccatttttgaacaagatatctttccaatttgtccaaccgccaactggttttgcagcaaaagtatcaatatcatcttctaaagcaacttcagcctgggctgcagtcataccctcttcatccatataataattctttagaccaaacttaatcaattcacgacgatcatctccactaagagtcggacggtaattgactgctatattggagaatccccagtcactacgaaaattaaattgagtttttcctgtggatcccctcttagttgtgatcacaataacaccattagcagcacgtgaaccgtaaagtgaggcagccgctgcatctttgatgaccgtaattgactctatatcattactatttaaggtagccaatacgttagtaccggtactattatatccttcacctgtattgggagtattaaaagcgctaatatttcctgattgtactggggtgccatcaattacatataaaggatcattccctgcattcatagaacccattccacgaatacgcacggatgttgtagctcccggtgcacctgaataggaactgatttgtactcccgggatagaacctgcaagtttatcttctacagccatagtggggatatcttgcaatttttcagtggccattgtggatgctgcacctgtgaaagtcgattttttaaatgtaccatatcctgtcaccactacctcatcgagaatttcggtatctgattttaatataattttcacaactggtttaattgctacctcaacagtttgcataccaatatacgaaatttgcaaagtctttgcagaactacaattatattataaactatttattatcagtattttataaaagatacagagaacttgtgcttatactacgatatcaatggttatatgtttgaatatcaaatatatatgataacagtactaacaataaaatccgaatgattcccatatctatctcccactattgtacgcgtaatccgcttattgcaagtgaaatatagattaaaaagtatgcgattgaaaaaagaatgttatactcaatagttccaaacgaaaaaaaagtcataaagcagtctattattattttacataaacggcttagaaataaaaaaggataattactaatttgatatttatataaaaacagagaatgccaacctaaatttccttataataggattaataaacttatatatttaataaacagtcaattaaaccgttcacattttgcatgtaggaagttagttttaacaccatgttaaaactaacttcctacatgcaaagaattagtgattttcaatcagaaaacaagttctttatagaagcggtacttgcgaactgtgattcgtgttaacaatgttaatagccaatacatctacgtaaggcacaaatctctgttacatgtaagatactttgcgattatttttagacttttctaagtctcgtacaatagttatgtccattatattagtataaacttgagttgttttcacgcttttatgtcccaatagcttttgtacagtagtaatattgactccactgtatattaataatgtagcattggtatggcgagcggtatggaacgaaatacgtttattcaaccctgataattttgctatgatcaataattccttattcacatttgaattatctctaagcttaaaaaaatcagcaagattatcctgatatttattcaagacttctattcctttcccctcaaataaaagataaagcggaaggcgcacttccgtattcgttttcacagatttataaataagccaggtttcctgatgcattttcactatgttttcaggggataagttggtgaagtcagaatatcgtaatcctgcataacaacaaaagaggaaagcatcttttgtcttttccagtttcataaaccggccatccaattccaaactttcaatctttcctaattcttctggagaaaggtgagtatgactgttttcgatacttttaattttatattttctaaaggcatatttctgtatctccatatattctttatttatggctacattgatatgtcttttcaaatgtttcatgtgcttcgcaatggtattggtgtgataccctttttgctggaggtaatgatcaaatgaggatataaattcaaatgtcagatctgagaatgacacatctttcttatagcctctcaataactccaaagttgataaatggttacgtttggtactctccttcaatgaagatttggctatttcgttgcggaagaacgcaataaacgaagttccatcatcctgactttccattgaattttttagtgaatccaatgaaatttgttttccctgttgccacaatcccagttctttcttctctatttctgccatgaactcatagagcatgtgattgatagcatccgcattagggtggtttttaaccatccttttcttgaaatcccattggtcaggactcaagtaaaccttggtagaaaaatatttcttcttcctgtttaagtaagcctcaacctgtaccaacgccatcccttttttgttcaggctcttttttctattatacactaaactgtaaataattttatccatttcctttatttttaattaatactatggacaaataagacgtgcatagactcaatattagaattgaataaggtttaatatctgctaaaacctgctatttttatatagaaataactaatttgtattttttaaaagtgactaatttgtatttataaaaacttccttgacagaaaaacgagcactatttttgctcatattaagccttgaatatacaaaaatagacaaaaatgcatattattagtacctgcaacatgttagcaatacaaaccccgtttatgttttttaaggcgtatttctatgttattagacataaaatcgcgtatttagataacgatttgttatatttgcaaggtttttttatagaaataattgttcgtttcatatttcttaatatatttgcattttgttagagtaaagaaacaattaatgtaaagttaaactttaagagagaatttatgaaaagaaaattaatgctgttattgacttgcctttttataggtataggtctagtaaccgcccaaactcagaaggtaacaggtgttgttatttctgaagaagatgggcaaccagttgttggagcctctgtattagctaagggcaccactgtaggtgttattactgatctaaatggtaaatttacgttatctggtataccaagttctgcaaagactttgcagatttcgtatatcggtatgcagactgctgaggtagcaattgcacctaatattaaagtgatattaaagactgactctaaggcacttgatgaagtggtagtagtagcttatggaacacaaagtgcacgtactgtgactgcatctgtgtcttctgtaaaggcagatgctttgaaagatgtaccgagtgtaagttttgatcagatgcttcaagggcgtgcatcgggtgtcagtatcactactccgtcggccggtgtaggacaggctccgattgtgagagtgcgtggtgtgaactcaatcacttccggaacttctcctttatatgtagtcgatggtgtgcccattgaatcgggtaacctttcttatttggctaatgccaatgcattggccgatattaatcctgctgatattgtgtctatggatgttttgaaagatgcggctgcggctgcattgtatggttcgcgtgctgcgaatggggttattttgattactactaaacaaggtcaaagtggtaaagtcaaagtgagctatgatggttttgtgggtttctcaaatgcgacagatttttatgaaatgatgaatgcccaggaatacgtggactttaagaatttggctgtaaagaaccgttatgggacggatgaattgtcactgactgccggttatgtttctccttatggtaacaaagcattcaatatgatgaaagatgccaatggcaactatgtagatacagattggaaagatgctgcattccagaacggattgtcacaaagtcattctgttgccgtaagtggcggatcggataaagtgcggtattatttgtctggtaactatacaactcaggaggggattgtaaaaggcgacaagtatgaccgtttaggggtgaaggctaacattaacgtacaggctactgactggttaaaagtaggaatgaacaccaacgtaacaaccgggacaacttcttatgtagatgctgcccgtagaggctctaactttgccgttggagggttcccgcgtctggcattgatcaatgcccctaatttaccgatgtacaatgaagatggtactccttattatttagctcaaggtctgggttatggaggaaatactgtgtttagtactttttctaatccggcggctattttatctttaggcaatggtttgagttctgatgtaacccgtttcattggtgtattttatgcagaggcaactccggttaagggattgtcattgaaaacccaatatggtgtggattatgcccgtatcgaggaacagcgtttctggtctccattgcatggagatggtgtgaacagtaaaggtctggcaaatgcttataacaccaaaaataacagatggacctggacaaatacggcaacttatagcttttctttgggacagaataattttaatttgttagccggtacggaggcatccgagagaaataactctcgttggactgcacagcgtaaagatttacaggatgataaattcattgtatttcagggaccttttggttcggcaactgccggtggtagcttgtccaacaataccatggtctcttatttcggacgtatcaactatgattacgcttctaaatacatcgtgtctcttaactaccgtcgcgatggttattctgctttgagtgagaagaatcgttggggtaacttcggaggagtttctgctgcatggcgtgtctctgaagaagctttcttccagcctttacgcaacgtggttgatgacttgaaaataaagggaagctatggtgtggttggtaacaccgatatttacgattatgcttcaaagtcattttattcaagttataattatggtataaatggtacatatggtttggctcagattgctgacccgaacttgaaatgggagtcttcggagaaatatagcattggcttcaatgcccgattgctgaataggatcaatgtagactttgactactattatacgaagtcttccgacttgattctggatgtgccccaatcaccttctaaaggtatcccgggcaatataattaccactaatgccggaaagatgaggaacagcggtattgaattgaccgtttctgccgatgtgataaagaacagtgattttacttgggaaacgagctttaacatcactactaacaagaataaggttatttcactggctgatggcgtggagaatattcttaaaggagataatggcggtttggaaattacgaatatcacagtacccggaaagtctatcggacgtctgtatctgtacccgactgccggagtagatcccaaatcgggtcgtagagtgtttatcactccggaaggtgacagaaccttactgatgtttgaaaaaggggggtggttctatgaagacggaacagaatatgccggtgaatttgaacctgttgattgtggaaatacacttcctacctggtacggtgggtggaccaataactttaaatataaaggtttcgatctttctttgttcttccaattctcgggaggtaataagatttataacggaaccaaagccagtgtgagtgatatgcgttactggaataactctaaagacgtttataataagtattggactccggaacgtacccatgcagagtatcctatgccgatatacggtgataattattctaatggttcggcattgcctatcagcgacttagtggaaagaggagattatttgcgtctgaagaatgtgtcactgggttatacgttcaatacaaagaactggtcgaaagcggtaggaatctctgcgctccgtctctatgttcaggctcagaatctgtttgtgattacaggatacagcggcatggatcccgaaacacttaccaatgtagaaagtgctactttagccggtggtacagataagaatactttgcctcaggcacgcacgtatacaatcggtgtgaacctgacattctaatatggttttatattaacagataaaagaaactacaatgaaaaagataattatattttcgacattatgcgcttctctctttttaggtagttgcagcagcagcttcctcgatcaggagcctccattatatgtaaacgagaacgatattttcacaagccctacccgaatagaggctactctgaacggcttgtatgctgcaatcaagaacacagggactaagtctttgatgggaggtaagtcctatatggtgtttgacaacaggggagatgatgttatcaatatatccaacaacttggtgactttgttcaatacctataatatgaatgtgggcattacggatgccgagaatgctgacacctggacatacgcttatctggccatcaataaagtaaatactttcctccagtctcttgaaggtgccaaagaagttgccggtgaaaattatgaccgctatgtgcaggaagctaagtttgtcagagctttggcatactattatctgaataatttgtatccgactccatattctgtaaatcccgatgcaaaatctgttccgttgcgtcttactgccgaggccggaaccgaaaataacaatatgcctcgctctacagtaaagcagatttatgaccacattctgtctgatctggaaaacatttcggcattggataccgaagtgaatacctatgcaggagttacacatgctactcaggccgctgccaacatgcttaagatgagagtttatatggcaatgaacgaatgggacaaagccattgcagccggagagttagtgaccggatatagtttgccggaagacgtaacattgatttataaggccccgtatttcagtcaggagagcatcttctctttgccgatggcagataccaacatcccgaatacacagcagtcgttggcagaatattactatgatggtaagatcatgttgattgatacgaaaagcggaattatgtcaaagcctgattattcgttggctaccgacaagcgtatcattgcctttaaaggggagaaagacttgttgttgaagtttacggatgcaaaaactaaattgcagtgggtgcccattttccgctatgccgaaactttgctcgaccttgccgaatgttatgccaacaaggccggaggtgaagctactgccaaaagcctgttgaaacaagtcagaggacgttcggtagatgtagctacggatccgttgaagatcgataacttgacgggtgatgcactgaaagaagcgatttacaacgagaaacgccttgagtttataggcgagggtatccgtggtattgatattatgagacgtggggaacgtttcattaaggtgggtgcgaatgaaacaattaatgtgggtccgtccgatgaaaaatatacttggccgatacctcaggttgagttgctgctgaataaagatattaataaataaatagtcaataaataataaagaatcgctcaggtagaaacacttgggcgattttttcttttagtatgttacgaaaatagctatatttgtcgccatattataataaggtataaagtagaatgaaagaatttgtaatatccgaagccaaagtcgaaactgctgttctggtaggtctcatcactcagacacaggatgaacgcaagaccaatgaatatctggacgagctggcattcctggctgagacagccggggcggaagtggtgaaaaggtttacgcagaagttgccgacggctaactcggtgacttatgtgggaaaaggaaaactggaagaaattaaagaatatataagaacagaggctgaagaggaccgggaagtgggaatggtcatctttgatgacgaactctcggccaagcagatacgtaacatcgaagctgaactgcaagtgaagatactggaccgtacttcactgattcttgatatatttgccatgcgtgcccagacggctaatgccaagactcaggtagaattggcgcaatataaatacatgttgccccgtctgcaacgtctctggactcaccttgaacgtcagggtggtggttccggaagtggtaaaggaggttcggtaggccttcgtggtccgggtgaaactcagttggagatggaccgccgtatcatccttaaccgtatgtcactgcttaaggagcgtctcgccgaaatagataagcagaagtctacccaacgtaagaaccgcggacgcatgatccgtgtagctttggtaggttacaccaatgtgggcaaatcgaccatgatgaatctgttggcgaagagtgaagtctttgctgaaaacaagctgtttgccacactcgatacgacggtacgcaaggtgattatcgataatttgcctttcttgctttccgatacggttggtttcatccgtaagttacctactgacctggtggattcctttaagtctaccctcgacgaagtacgtgaggccgatctgctggttcatgttgtggacatttcgcatccaggatttgaagagcagatagaggtggtgaataaaacactggccgacatcggtggaggtggaaaaccaatgattttaatatttaataagatagatgcctatacctatgtagaaaaggcgccggacgaccttacccccaaaacaaaggagaacttgacactcgaagaactgatgaaaacatggatggctaagatggaagataactgtctgttcatctccgcccgtgagaaaatcaatatagacgaactgaagagtgtggtttatcagcgagtgaaagaattgcacgtgcagaagtatccctataacgactttctctatcagacctacgacgacgaagagtaacttgtagtttgtaataagaggattatgggaaagacttaccgtagactgactgaagatgaaattcttcagttgaagagccagtcgtgtctggctgatgactggaaccatgttgcggtcgctgaagagttcacaaccgaatttgtgcatcacacccgtttctcgggagaggtgaaactgggcgttttccattcggactttatcttgccgggaggaatcaggaagcattccgggctgaggcatgtcaccttgcacaatgtaattgtgggcgacaactgttgcattgagaatatccagaattacattgccaactacgaaataggaaacgacactttcattgagaatgtagatattattctggtggatggtctgactcagttcggtaatggagtagaggccgccgtgctgaacgaaacgggaggtcgcgaagtgttgatcaatgacaaactatctgctcatcaagcttatattctggctctttaccggcaccgtccggaactgatcagccggatgaaggcgatcactgactattactccaacaagcatgcttctgcgatggggaccatcggcagccatgtgatgattctcaataccggttctatcaagaatgtgcgtattggcgatcattgccggatttgcggaacctgccgtctttacaacggaagtatcaacagcaatgaagccgctccggtacatatcgggcatggtgtcatttgcgatgactttattatttcctccggttctcatgtggacgatggagctatgctgacccgttgcttcgttgggcaagcctgtcagttgggacacaactactctgcttccgattccctgtttttcagtaactgccagggagagaacggtgaagcatgtgccatctttgccggtccgtataccgtaacccatcataagtctaccttgctgatagccggtatgttttcgtttatgaatgccggctcggggtcgaaccagagtaatcatatgtataaactgggaccgattcatcaggggacgttggaaagaggagctaagactacttccgattcatacattttatggccggcgcgtgtaggggctttttcattggtgatggggcgtcatgtgaatcatgccgatacctcgaacctgcctttctcttacctgatcgagcagcagaatacgacttatctggtgccgggagtcaatctgcgcagtgtcgggactatccgcgatgcccagaagtggccgaagcgtgacaaacgtacggacccgaaccgcctggactatataaactacaaccttctgagtccatatactatccagaagatgttcaaggggcgctctatactgaaagagctgaagcgggtgtccggcgagacatcggagatctattcttaccaaagcgcaaaaatcaagaactcttcgctgaatagcggcatacgctattacgaaatagctatccataagtttcttggtaattccatcattaagcgtcttgaggggattaacttcaaagataatgaagagatacgccggcgcctgaaaccggataccgaaatcggagtaggcgagtgggtggatattgccggtttgattgctccgaaaagtgaagtggaaaaactgattaccggtatcgaaagtggtgagatcaatcgtttgaagagtatgaatgcccgttttgccgagatgcacgataactattatacttacgaatggacgtgggcttaccataagatacaggaattttatggtctgaacccagaaaccattacagcaaaagatgttatcgctatcgtccgtgcctggcgtgaagcagtggtcggactggaccgcatggtgtatgatgacgcacgcaaggaattctcactttcgtctatgacgggttttggtgccgatggctcacgcgatgaaatgaagttggatttcggtcaggtacgtggcgattttgagagtaatccgtttgtcactgccgtgctgcaacacattgatgataagactgctctgggtgaggagctgattaaccgtatcgggcaactggcgtgacggaattacgagctacaatatatttgctatgaaaatacacattttatttggaatgatcgggttcttcctgctgaccggatgttgccggacagcagagaagaaccctcgtttttatgatgccggcgtttctaaagagcttgccgagcatcgtaaagccgagattaagaatttgaagtatgaactcagtttcagcattccacggcagaaggagacacctattgacggtgatatcaccttgcgcttcgaccttgctgccgctcaggaagtcctgattgattttcgtgaggagcgtggaaaaattaaagaagtcattgccaatggaaaaccggtaagtgatgtgcgctttgagaacgaacacattattctgcctgcttcgctgacagcgaaaggggcgaatgacatacagattcgtttcattgccggcaatcagtcgctgaacaggaacgatgaatacctctatacgttgctcgttcccgaccgtgcccgtaccgtcttcccttgctttgagcagcccaacctaaaagccgagtttactttaaagcttgaggttccggccgactggaaagctgtttccaacacatacgtccggagtgaaacagtagccggtgaccgtaaaaccgtttgttttgcaccgaccgaaccactcagtacttatctcttttcgtttgtggccggaaaattggagcgacaggagtatactcaggacgggcgtaccatcgccgcctattatcgtgagaccgaccctaagaaaatagcacagttggatattgttttcagacaagtcatggcatcacttcactggcttgaagagtatacagggatcgcatatccgtttgccaaatatgatttcatcgttcttcccggttttcagtttggcggaatggaacatacaggagctaccttatataatgataacgggattttcctgagcgaacatcccactccggacgaggagttgaaccgggtggaattgattgcgcacgagacctctcacatgtggtttggcgatcttgtaacgatggattggtttgacgatgtatggaccaaggaagtttttgccaattattttgctgcccggattgtcgaacccttgtttccggagatcaatcataccctgaataagctcaagacttttaatgccgcttctcttaccgaggaccgtactttggggacaaatgccattcggcagccacttgataatctgcgtaatgccgggctgatctatgggcagatcatctataacaaggctcccgtgatgatggaaaaactggttgacaggatgggtgaagccaacttccggagtggtatacaggagtatctgaaaacctattcgtacgctaatgccacttgggacgatctgattcgcattttagacggcaaggtgtccgaagatttggcaaccttcagtgatgtgtgggtgaaccggaaaggaatgcctacgctgaacttccggatcgatggacaagaattggaggtccgtcagagtgatccttataaccgtggtttgctttggccgcagcgttttgccgtcactctttgcggagagcgcgattcggtgttgcgggtgaatatgacggatactttggttcggatacagcttccttttgtaccttcgttggtgttccccaataccgatggcagaggttatggcttgttcgttcccgacgaatctgctttgaagtggctgttggcacattggtgggaggtaaaagacgatacggcacgccaatcactcttgatgacactttatgagaattacctggctaaacatatttcggcggacgactggacaaacagcctgttggcagggcttcctgcagaaaagaacgctctggtagcgtctacagtgagtggttatttggcgggtgccatgcggcgggtagctccggcacagatagcagaggttgaggcgcgggtctatgccatcagccggaatcatccgttgccttcgtgccgggtgcagttgctgcgttattttatgcagaatgcgacttcccaacctatggtgaagcaactttatgccttgtggcaggagcaatcggacaaacggttgaaccaacaggattacacgactttagcttacgaacttgccatccgcctgcctgccgaaagtgaacagatattacgtacacaacgggcacggattgatgatccggaccgtctgcgccagttcgattttatttcacggtcggtcatatccgataccgcacggctcgatactttgttcaacagcctgcttgtagcggaaaaccggcggatagagccttggacggctgccgtgatacgttatctgaaccatccgttgcgcgaggagcaatcggtgaaatacatccgtccgggactcgaggtgctggaggaagtacaacgcaccggagatattttctttccgaaaaactgggcctcggccttgttgggcaatcatctcagccgcccggcttatgaagaagtggtgcgtttcctggacggccatccggattattcaccgcttttgaagaacaagatattgcaggctgcctattccctgtatcgcgaaaacgattaaaataattcccggaatgcttgactttgcctgtccgatgttgtatctttgtcaacagattcattatttatattcaaattagaatgcagtagaagaggaagcccgcaaagcttcctctttttttgtacccttatctcccggtgtcccggagccgggggcttttctgctctttccccggctctccatgccctcgagaccgttgctctgtgatgtgaagagccttgcttcggcccaaacagacggttgcatttgtccggacagacggttgcattccacagaaatgagcctttcttccggagcggtctcttcttcttcgtagaaacgctctccgaacgttaataataagtaaatccgctcttgacaaaattcaccactttattcatactttggaaaactattcttacctttgcctcactaactaacattacgtaataaaataaagagatatggcaacacctccgtttaagtatcaacctatgttcgaacatggggaagataaaaccgagtattatctgcttaccaaagactatgtgtcagtaagcgagttcgaaggaacacctgtgctgaaggtacagaaagaaggtctgacagctatggccaataccgctttccgtgacgtatctttcatgcttcgccgctcacacaacgagcaggtagcaaagattctgagcgatccggaagcaagtgataacgacaagtacgtggcattgactttcctgcgcaacgctgaagtggctgccaaaggcgtgcttcctttctgtcaggataccggtacggccatcattcatggtgaaaaaggacagcaggtctggaccggctattgcgatgaagaagctctttcactgggtgtttacaaaacctatacggaagaaaacctgcgttactcacagaacgctccgctcaatatgtatgacgaagtgaacacgaagtgtaacttgcctgcccagatcgatatcgaggctacggaaggcatggagtacaaattcctgtgtgtgaccaaaggtggtggttctgccaacaaaacatatctgtatcaggagacaaaagcgatcttgaatccgggtactctggttccgttcctggttgaaaagatgaagacattgggtacggcggcttgtcctccttatcatattgcattcgtaatcggaggtacttcggcagagaagaacctgttgaccgtgaagctggcttctactcactattatgacgagttgcctactaccggtaacgaatatggtcgtgcattccgcgatgtagaactggaaaaagaagtacttgcagaagctcaaaagataggtttgggtgcgcagttcggcggtaagtatctggcacacgatgtacgcatcatccgtctgccccgtcacggtgcgtcttgtccggtgggcttgggagtgtcttgttctgccgaccgtaacatcaaatgtaagatcaataaagacggtatctggatcgagaaactcgattctaatccgggtagcctgattccggcagaattgcgtaacgcaggcgaaggtgatgttgtaaagatcaacctgaaccagccgatggcagatatcctgaaggagctgactaaatatccggtggctacacgcctgtcactgaacggtacgattatcgtaggtcgcgacatcgctcatgccaaactgaaagaacgtctggatcgtggtgaagatctgcctcagtacatcaaagatcatccgatttactacgccggtccggccaaaactcctgccggtatggcttgcggttctatgggaccgactactgccggacgtatggactcttatgtgaacctgttccaggaacatggaggcagtatggtgatgttggcaaaaggtaaccgtagccagcaggtgactgatgcttgccataaacatggcggcttctacctcggttcaatcggtggcccggctgctatcctcgcccagaacaatatcaagagcatcgaatgtgtggaatatccggaattgggtatggaggctatctggaagatcgaagtagaagacttccccgcatttattcttgtagatgacaagggcaacgacttcttcaagcaaattaaaccccgttgcggctcttgcagcaacaaataagaatctggtgagtggccattaatattggttatttatcatgttaactcgagtgagaggcgtctgtatgctgtgttatacagatgcctttcttattataaacaccttaatcattatcagtaaaacaattccccgatggaactacagaaaaatcctcaacacattgtctggctggacgttgtccgttttgttgccatgtttaccgttgtctgttgccactgcacggaccctttcaacttttatccgggcactgcccctaatattgacgaaatcaaactttggggtgccatctacggagcattgcttcgtccttgcgtaccgctgttcgtgatgattaccggagccctgcttctgccggtgcgcggcgaagtctctgtcttttataagaaacgtatcccccgtgttttatggccattcctcatctggtcggtcatctacaacctttttccctggattaccggtctgttgggcatcaagcccgaaattattctcgactttttcccttactcgggggaggaagtgatgcgccagtcgctgtccatctctttggattacattgctcagattccttttaatttctccattgtagatgtacacatgtggtatatttacctgttgatcggcttgtatttttatcttcccgtcttctctgcctgggtggagaaagcatcggataaggcgaagttgtggttcctcggtgcatgggctgtcactctgttattgccgtactacaatcagtttgtagcgcaatatctttggggaacctgttcatggaatgcgttcggcatgttttattactttgccggtttcaatggctatctgttattaggacactatctgcgtaaccttgactggacgttgggtaagattctggcaatcggtctgccaatgtttgtgataggatatgccgttaccttctttggcttccgttacatcacggctttgccggaatacagtgacgagatgcttgagctcttcttcacttactgttcgctgaatgtagtgatgatgaccatcccggtgtttatgctttgcaaaaaggttaacttccgttcggagggaatcaagaaagcgcttgccaatctcactttgtgtggtttcggtatctatatgatacactacttttttaccggcccttccgtactgttggtacgtacgttgggagtgcctttgggcattcagattccggtagcgtctgtcatggcatttggtgtttcgtggctgatcgtatgggctgtctatcgtgtgctgggcaagaaggcgaaatggattatgggataaaacagtaattaaagcatattatttatgaatcgtaaatcaatactattaacaatcttactttgtgttacttctttgacaatggcttctccggtgaccggcttgttggagcgcatagacaaaggagcttcgaagaagtttattgtcgagcaagtgaagtccggtaccgacttttttgaactcgatcagaagggtgataaagtcgttatccgtggaaacaattacgtgagcatcgctaccgggttgaattggtatctgaagtattatgccggtatccacctttcctggaacggaatgcaggcaaaactaccggctgtgcttcctccggtgacaaaaaaagaacggagagaaacgaccctgccttaccgttatgatttgaactattgtactttttcttattccatggctttctgggattgggaccgatgggagaaagaaatagactggatggctttgcacggcatcaatatccctttggctgtgaccggggcagaggctgtgtggtataacgtgcttgataagttgggatataccaaaaccgaaataaatgagttcatatccggtccgggcttttttgcctggtggctgatgaataaccttgaaggctggggcggacctaatccggatagctggtatacacagcagattgctttgcagaagaaaatcctgaagcgtatgcgtgaatacggcatcgaaccggtccttccgggttattgcggcatggtgccccataatgcgaaagagaaactcggattgaacgtatccgatccgggaacatggtgtggctatcgccgtccggcattcctgcaaccaagcgacccgcgttttgaggaaatctcttctctctactataaagagcttgagaaactatacgggaaagctgacttttactccatggaccccttccatgaaggaggcaatacggcaggcgtggatctcgatgcggcaggtaaggctgtgatgaaagctatgaagaaggccaatccgaaagcggtttgggtggcgcaggcatggcaggcaaatccacgtccgaagatgattgagaatctgggggccggtgacttgctgatactcgacctgaccagtgaatgccgtccgcagtggggagattccacttccgaatggtatcgcaaaaacggatatggacagcacgactgggtatactgtatgttgctgaactacggtggtaatgtcggactgcacggaaagatggataatgtgatcgataatttttatctcgctaaagccgatccgcacgcaggttctacacttaaaggtgtggggatgacccctgaggggatagagaataatcctgtgatgtacgaactggtgatggaactgccttggcgtgcagagcggtttacgaaagaggaatggttgaaggagtatgtgaaagcacgttacggtgcagatgatccagtggtacagactgcctggaccaaactggcgaactccatttataactcaccgaagaacctgacgcagcaaggtacacacgaatccgtattctgtgcacgtccggcggaagatgtgtaccaggtgtccagctggtcggaaatgaaagattactaccgtccgcaagatgtgattgaggctgcacgcctgatggtatctgtggccgatcgttataaaggaaacaataattttgagtacgatctggtggatatcgttcggcaggcacttgcagagaagggcaggctgatgcagaaggcggttaccgctgcttaccggagtggtgataaagaactcttcggaatggcttctcagaagttcctgaacctgattctgttgcaggatcagttgttgggtacccgcccggagtttcgcgtaggaaagtggattgaagaggcgcgggcgttgggtggtacatccgcagagaaggctttgtatgagtggaatgcccgtgtgcagattacgacctggggcaatcggaatgcagccgattacggtggcctccgagactatgctcacaaagagtggaacggattactgaaggatttctattatatgcgttggaagctttatttcgattctctctctcagaaactggaaggtaaaaccccggagaaaattgatttctatgcagtggaagaaccttggaccaaagccactaatccctattcggcggaggctgaaggagattgcattgaaacagcgaagcgggtgatgcaagcggtggaatagtatatcgcaaagttcaccacagattacacagattatttattacgtagataatctgtgtaatctgtggtgaactcgtttttagactatttttgcttcgctgtccctttccagatacgcatcatataatatgcacaatgcgtaaatgcgaaaacaaacgagattatcagcaatactttactttcgtcccaacccaccgtctgctggtgccatagcccggtgatgacacaaagcacagacagtgcgataccgatcatgttcaatgccgattgtccccggcggtttttcacgccttgttccagtttgctgtgcttcataccatagccaacgtaaatatccaacccgatgagcatccacaataccagacgtatccaagtatcggcgggaaggaaaagcatcatgcacaggcaggtgagtattcctaaaatcgggacgagtggcacaaacggagttttaaaagaacgggggatatccggcatggtctttcgtactaccaatacggcggcacataccagtgtgaaagccatcagtgtgccgatgctggtcatctctcctgcaaggcgtgccgggacgaatgcagccaataaacctactatcagcataaacaggagattgctgcgtgccggtgtgcgaaacttttcattgatgtgcgagaagaatggagggagcagtccgtcatggctcatactcaggaagacgcggctttgtcccaataaagtgaccataattacagaacagtaaccgaacaggatggcaagaacgatagcacggttcaaccagggatagtccggatggatgatgcctgccgcatcggtatgccccatatgttcgatggcaatagctaccggtgcaatgccctgctgtccgctaaactcggtgtagtgggcaactcccgtcattacgtgggcaaacaacatatagagcacagtacaaacaaggagtgataccaggataccgatcggcatatttcgtttcgggttctttgtttcctgggcggctgtactgacggcatcgaatcctaaaaaagcaaaaaagacaatagctgccccgcgtaagacacccgaaatcccatactctccaagtgtgcctgtattggcgggaatgtatggagtatagttatccgcattgatatatttccagcccaatacgacaaaaatagcgatcaccgatactttgaggaatactacgataccgttaaagatggaactgccttccgtaccgcgaatcaggaagatactcatcagtaccacgatcaggaatgcagggatattgacgattcctccatcccacgggcaggcggttagtgcttgcggaagatgtatgttgagcccttcaaggaagaccacgaggtatctgctccaactgatactgacagtggtagccgctactgtatattcaaggacaaggtcccaaccgatgatccaggcaatcagttcgcccatggtggcatatgagtaggtataggcacttccggcaaccggaatcatggaagcaaattccgcatagcagagtcctgcaaaacagcatcccagtgcggcaatggcaaatgaaagtgtaatggccggtcctgtatagcctgctgctacggttccggtgattgagaagagtcctgctccgataatgacaccgacacccagtgctaccagactccagggacctaatactcgtttcaatgatttacttcctgacgcattggcctctgccaacagggcttcaaagggtttctttatgaataatcccatctttctgtttctttttttacttagttgtacgtggtacacaaagagtcgtggggaatatcgcttggtttgcccgccgtactcttgtgattggattggctgcaaagataagcaatctgaacgggcgatacaaggcttcttttgtattaaaacaaacagttccgtcggtttaaaaggtgggggtgtgtcaaaagtctttccctctgtggtaagttttgacacacccccgaatgttgtaaggagaagggcaaagtgtacgtttagtccagatattttgttattttcccactgatctgtagcagggagatttcgcataacttagtgtcatattcggcagatagaattcgctcttccgcatccagcagactcttctgtgcttcacgcatttcgatacccgaaaggtttcctaacatatatcgttccatggctatctcgtgattctctttggcagccaccaggttttgccgttccagtttcagcatttgcagattattctggtaggcttgccacagattgctaaggtctgctttcagtccttgttccagctgctcccgttgcagacgggcgtttttgatggcgatacgtgcgttgttcttttcgcgacggcggtttccgtcgaagatattgaatccgattgttaccccgaagttggcacccagattgcctctttggctattagaggcaatgtcgtatttattaaaagtatagccatatccggtattcattttgaggtatgggtagttacgagagtttacctttttatagtccagcatggcgagtgtattgttctgttcggctttcagcaatgaagcgttggtcagtagagtggcgttccataattcttcgaaccggagtcctgcgttaactttaatgatactgtcttctatcacaatcggctggtccacatcttcattggccatcagttcgttcagctggatgcgcgacgtatgcagcaattcctgttgcttcatatatttggcactgtcagcattgaagtctactttggcctgttgatagtccaggcgggagaagttaccgatgtgataacgttcttccacgattcgcaggcgttcttttgacaaggatacggcgtagcggaagttctgaaggcggattttctgttgaacgtaattgtagtattcggctgcaaggttagctatcaggtcttcgatggcaatacgggtattggtttctccctgtcgttccaactctttcagcttttgataattggcagtgatgttgaagccgtcgaagatagtccagttcaggttcagccccacgttaacggtctggtcgaagacaccgttttcttttaccgactccccggtagcccggaccttggtgttggtattgtccacagttcctgtataaccggccgttaggtcgagggtaggcaggtagccggcattacccggcgtagcgttatttttgcttacttgctcttcgttacggactatttgcagggaataattattctggaggccgtactccagacaggattttagagtataaatttgtggctgttgtgcttgcagacccaaaggggtgcagcacaatgctatgataaatagggcaatctgtttcattctctctttaatttattacttcggttcgtcgaaatataactgtaaatagcgggtacgatgtacatagtcagcaaggtagataccaacatacctcccacaacagccgtacccattgcaatgcgctggttacaaccttcacctgaggcgaacgccagcgggatcaatcctaagatggtagaagcacttgtcatcaggatgggacgcagacgctgcaatgccgcatccttgatagctgtcagtttgtcttcacctgtttcctgtttctgattggcaaactccacgatcaggataccgttcttggctaccaggccgatcagcataataataccgatctgactgaagatgttcatcgtgataccgccgaagtacatgaataccagtgcaccggcgatggccagaggtacagtcagcatgatgatcagcggatccttgaaactttcgaactgtgccgccaggatcaggtaaatcagcacaatggccaggataaaggcaaacatcaggcttgaagaactttcacggtactccttcgaatcaccggtcagtgccgtacggaacgtgtcgtccaaagtctctttggctatcttgtccatctcgtccagtccctgtccgatggtcttgccctccgccagtccggcggaaacagtagccgacacgaaacggttgtaacgatacagcttgggaggtgcgatgccgtcggtcaactcgatcagattgtcaagctgtaccatgtctcctttgtcactgcggatgtagattgctttcaggttggcaggcgtattgcgttgttgacggttgatttctcctaagatttcatattgcttaccgttcatatagaagtatcccatacgctgtccgctcaatccgtattgcagggtttgggcaatgttgcgggtacttacccccattatactggctttatcgcggttgatattgatacgtgcctccggtttgctgaatttcaggtctacgtccgccatctggaataccggattttcgtataccttggccatgaacttaggcagtacttcctgtagtttctcgatattggtagcctgcaacacatattgtacgggcatgccgccacgccgtccgccaaaagaagacgattgctggacgaacgagcgcgccatcgtctttttctgtactgcggccgatagcttttcggcaatgtccatctgtgtataatcacgatccttcatatctttcagcgtgatgcgtacattaccgctaccactcgatacacgggctgttaccgactctgcatccggtacgatcgagtctaccagatcgtttatgtcttccgtatagtcacgaatgtactcgtatgtcacaccttcagcaccacgggtgttgatacttatttgtgagcggtcttccagcggagccatttctgcaggaatgtggttccataagaaagcgatgataccgattgtgatggctacaaaaggtaaggaaatccagcgcttgttgaggaaagcagccagtgaacgactgtacagacggttcattccttcgaagaagggttctgttttcatatagaaccagttttgtttttcccgttttaccaacagtttggtggcaagcatcggagtaaaggtcagggctgcgaatgaagagataatcaccgatccggaaactacaatactgaattcacggaacagacgtcctgtcataccctccataaagacgatggggaagaacacggccaccagcgtaatggtggtggagatgacggcaaagaaaatctcttttgctccttcgatgccggcttctttcggaggcatacctttctctatgcgtacatagatgttttcggtcatcacaatagcgtcgtctaccaccagacctaccgccaacacgaccgccagcatggagagtacattgatggagaagtccgccagatacatgacgaagaaggcaccgatcagtgataccgggattacgatacagggaaccagcgtcacccgccagtcgcgcaggaaaaggaaaataatgatgataaccaggatgaaggctacataaaccgtctcttttacctcatagatggatgcacggataaacttggtgttatcgaatccgtaagaatacttcacgtcttcgggaaggtctttctgcatcttctccatgcgttcgtacactgcgtcggctatcttgatatgattggcaccgggttgtgggattacgacgatacctaccatcggtactccgttcatcttcatataacttttgatatcggccggccccagttcggcgcggcctatgtcactgaaacggataatacggtcgttctcttctttgatgatcaggttattgaattcttctgcggtgtgcattaaccccaaggtacggatggtgagctctgtcgtatttccttcgatactgcccgaaggaagttcgacattttctttgtctactgcattctttacgtcgataggggtgatcccataacccgacatcttgataggatcgagccataagcgcatggagtagcgcttttctccccaaatggaaacgctacttacgtcggagatggtttgtaattgttcttttacggtcaggtcggcaatttcactgagttccagcaaggagcgtttgtcactttgcagagctaccatcaggataggagtagcatcggcatctgccttcgaaacagtaggagggtcacagtcgcgcggcaggtagcgctgggcacgggatactttgtcgcgtacgtcattggctgctgtttccagatcgacggacagctcgaactctaccgtgatacggctttgtccctgctggctgacgctggacagcgaacggatacccggaataccattgatgttctgttccaggggctcggtaatctgattctcgattacatcggcattagcacccggataggagcaggatactgagattataggattatctacagacggatactcccggacacccaggtagttgtacccgatcagtccaaagagtaaaatgatgatggtcaataccgttgagagtaccggccgtcgtatgcttaattcggatatattcataaggcggtcgggagttaattgatattatccagtgtgacaggtaatcctgtacggagttgaagggttcccgaagtgatgatggtatcacccatctgcagaccttttatcacctgcacttcagcttcggtacgaatgcctgcggttatttctaccggttcagccttgcccgatttatagaggaatactttatccttacccatttccggtacaatcgcttcggatgggatggcaatggcattcgggatttcttcttttttcagctgaatgctggcgtagcgtcctgggagcagtgcgccgttactgttggcatatagggcacgaacggtcagcgtacgggtagactggtcgattcttgactcggttgcgtatacttttgccggaaaagaacttaatttaccttccagctcgaagttgaggttggtgcctttctttacctggcttgcataacgttctggtacggaaaattctattttcaaaggaataattttcgtcagtttggctacgatagtggttggtgaggcatatgaaccgacactgacttgccggagcccgattactccgtcaaaaggagcgcgaagttcggtcatggcaatgttagctttcaccaggtcgatgtccgcattgagggtagccagttccgtttttacttgttcgtaggcttctttactgacagcgtcccgttcaagcagagcgttctgacggaatacacgatcttcggcaagctttaactgagctacgaggcgttgcaactgagcctgcaactgacggtcgtttactttcgccaatagctgtcctttttttacggcactgccttcgtcaaagttgatttcaacgatctttcccgaagtctcgaaagaaagatccacttcttcatcaggcatcaagctgccgctaatttgaatctgatctgtcagcaattgtggctttatgatcttggcatttacattcagaactcttttgttgatctgcttgccagccatcactttgtcggctgctgccaactcttcatttgctttaggaagctgagagtagataccccagcctatcagtccggcaccaatcaatgtgatgatgccccatttaacctttttatccatgtcttagtattagtatatgtccgttctaagattagactaagagggtgggaaaaggtttaatcgggaaattaaaatatagatttattttttgtgttaaggtgtcttattgattatgttttcagtatatgaaagccccaatatcctttcagtaaaagggtgaggacttattgtaacagtcatcgaatcatcctcctgataaagtgcgacggttcttttcttcttcgcggattacgaactaaccaacggtatttgtttttggtcttaaaggcttgtatccaaaattattatgatgaatctccgtttgtttattccggccctggtatgcgggctcatgggccttggtatgcgggcttataagcccgagtatacgggctcatgggcccgggtagcggggatgggatgaagagcggatcattttcgactaaacagtaaaggaaagcacaatgctttaaacaatgtattcagttaataaatacgttccttagtgttgcttatcagtgtcttaacgattggatggcgctcaagttaacgggtggaagatggaagatgcgggtggaagataaacaggctgaaaatgcgatcttccaccgtgtcattgcattgattattaatggagtaagtggaaaaaggtggaagatggaagatcgaaacgtattttttgtaggagaagcagttactctgctaagtgaagcattaaaatagaataaagaatattctctgaaaaatagcagagattcagtatgctgcgcggtattttccttcctccttatcctcaagcatactcagataggaagtgtagcgtgattcgctgatgtagtgctcttctaccgctttccgaacagcacaaccgggttcttgacggtgtgtgcagtttccatatttgcagtctgccgaagtcttgaatatttcggggaagtaatggcctatctcttcctcttccatatcaaaagtgccgaaacctttgataccgggtgtatcgatgatatatccgttgccggggacggggaacatttcggagaaagtggtggtgtgcattcctttgttgtgataagctgatatctctgcggtcttgacttccagccctgggacaagggcattgatgagggttgatttgcccactcccgaatgtccggagaagagggttacccggcctttcagttcctcgcgtatggcatcgactccttcaccggtcagtgcggatattttaaaacaagggtaacctatttgggtatagagggtgatgaggctgtccagataatgcagttcgtcttcatcataagcatccactttgttgaaaagaatcttcaccggtacacggtaggcttctgccgacgccaaaaaacggtcgatgaaggtggttgaagtttcgggatagttaatagtcaccaccagcatacattggtcgaggttggctgcaagaatatgcgattgtttggagaggttcgatgaacggcggatgatgtaatttttccggtcttctatctcattgataaaggccgttccttcttggttgagtatgatttgtacacggtcacctacggcaacgggatttgtactccgtatgcctttcagccgaaaattacctttgatcttgcattcaaccaactgcccgtcatcggttttcacctgataccagctacctgtattctttattactaatcccttcatgttttataaactgcaaattacaagttacgagctataagaaatgattggagaggctgtgcttgtgcactgcactcgtagctcgtaacttgtaatttagaattatacggtcataatttctttgtccttttcagccagcatttcttcaatcttggcgatgtacttatcatgaaccttctgcagtttagcttctgcattcttttgttcatcttcagccaaaccgtcttttacagcttttttcagtgcatctataccgtcgcggcgcgcgttgcggatacttactttagctgtctcgccttcagctttacactgtttggcaagttgtttacggcgttcctcggtaagaggggggatgccgatgcggataatttcaccgttattctccggcatgataccgagatcggagtcgataatggctttttcaataacccggaacatgcttttatcccaaggtttaatcgtgatgctgcgtgcatcgggagtggttacggcagctacgttgctgatgggcaccatgcttccgtaagagtctacacggataccatccagcaggcgtgtgcttgcttttccggcgcggatgtgtgccagtgcttcttccagatacatcactgccatatccatcttctcttgtgattcttcgataatcgtttttacgtctaccatcttattaagtctttataaaattggcactttgattaattttgaaaacaaaagtagattattttttggttatctgcaactatctatagagagaaatgcattgcctgacgtttctctttctaaatagtattattggtaattatcgcaataggtggtagacgggctgctgatataacgtccgcttaagttacaactggaaccactgaggtgactacaattggagcatcttttaccgccggatgaagaagatgattttcctaaaagtgaaagcaaaaagagagcaattagtacaattagtaaaaggatgaggaaatgagctacaattaagacagtggctgttgaaccaattaaataagttaatgtacagatacacgcatgtttccatccacctttgggaagtactttattgaaaataatacctgtttgcacagattgtccgacaagaaatccaattcctatcacaggcaaaaagcctgcaaagaaaaagccacaaatgatagcgcctatgatacagatgccccaagtatatattccccatgtccaattgaaagttgcgtaggaattgtattgcacatcattcaaggtattgaaaaaacacatccattgattaaatacaactgcaccgaatataaagaaattaatgatggtccatagccatcctattttatcgggagtgcaaaaccaaatactatttgcgcccattgaaaacacataaaatagttctaacaaacagacggcaatgaataaactgaggtttatcgtatgttcggtgtcttccagcggagtactttctccacgacgcattctaaggatgaatagcacaatagaaagtcctaatatgatataaactaaagggcggcaatcataatttgtttgtcgaaaccagtcgctgaatgtatttgttggagcttttgcgggaggtgttggagtaacaggtcgtatgtaggccgtacttacgtatccacatccgccattgaaggatatctttgcccattcgccatctattgattctacatttacgattcccccatgatttattgttccgatgacaggagcatttgtgcttccatgactacgtatgtttagaaaagtattggcggtcacttcatacttttccaaagcttgggtagagaggactataatgaatagtccgatacaaatgaacaggaatcgtttgaatgttttcatcagtttgttatttactgggttttatgtcttttacagcaggcgtgatgataacagttgtcggcactcggattaaagatactaatcgctctaattctgaatttttgattcgaatgcatccttcggtcgctcgggtcccaatagataatgggtcgtgggtgccatgaatcccaattcctttatgtccgggtgtttctaaccggatgaaatgattaccgtatgcaccctctatttcacctttcccatctccaaaatcgtgtttccatttagaagcatcttggatatcgattattttaaaagttccttcaggagtttttaaatctccttgtttttccttattgccataattcttcccacaagctatgtcggcagtgaataattcttggcccttatagtctattaagcgtaatttcatttcatcttttgagatgagaagaatgttcgcattcttaatttgtgccatttgggcagtatggtagtagtagaaagctactgccataccgcctatagaaaggataaatgttagatgcgatattattagataccgtataattttctttttcattgtattatgcttagtgtacaattacttggcaggagaagattttacttccctcgtaccatatctcgtactgataagtacctggagaatacacgtcacactctggacttccccagcttgttaaataagaaacattgttatcagctccgacagcaggtgtatatataccatgcttgtaagtgtatccgttcggcgagttcttgttggcaatgagtacaccattgggacgatagattttggcatacaatgtaatgtttctggccccgtttagacttgaataaataatctttggtttcaggtattgtaatttatttccgtaaagcggcttcccataatcttctaaaatggtccctttatcgtttgagttggcaaataacattgttcggatcttgatgggacactcaacaggttttgaagaaacggttacagccttttctgaattgccctgaatttgcactccggttgaatacaataattgtccttcggaccagaattctatccggtaagttccagaagtgtacgcatctccggtcgtatttccccaaccggctaaattaatatatccggatctgtttagagttactttttgttcattagtatatccggagggtgatcctgttccagtcattaagttcccctgtggagtgataattttatatttgatgaccgctgaactcttccccgcaggattttcatagaaaatacgtggagacaagtactgagtggtggtggggagctgtgtcccaaattgagtaagaacattgtaacttttatcagtgtttccaaaaagtgccttcgttatttttagtccgttctcgctctttgtttttgacggctgctggttggttgggagttgaggcgagcgactaaccgtagcatttggggtagcatagataactttatatttatctgttttccatggataatatttaatatcttttatttgggcattttctgttgtttgctcttgatatataaaaacgggagtttcgtcatctgcaaacgaataaatagccagtacgccttcgtgtgtggaggtgttggataagataaacgcaaattctgtaaacttcgtatatccgttagccaggcgggggtaaagtactgcgttaggtttgacttctatgggctgtgcaaacaactgccattgtcccgtccctgttttatagttgtttttctttataaagtctacgagtgccagccgacattttgctgtcggtgctccttccatagcttctttgcttccccataagttattcaacaattcaaaatcagccttacttagggtgtaattggtagatacatatccttttttctcattggctttaatgtatgaccatccatctccttctttttggtaagtgatgagctccgaaccatagggcagagattggatacgattatattctacatttgcatttttatcggaacgttgcagcaagctggatacgtatacataggtacgctctgcgtcccgatcaatggccataggtttataccaatattgatagccgcaaaagcctatgatagcggtgataatcaggaacgaccacaaacctccgtgcccctttttaggcggaactgtagatgttcgtcggttagatggggttcttggaggaggcggcggcgttacccgtgactgcgggggcggggtagaggcccggtattgtttgattgtgaatgtgtacgttgcaatttgcagatcattctcaaagaactcaataatccattggccagcggagaatacatttccagacatacttccgaagccattcaagggatatgcagatcgggaacctgtgagagggacattgccataccacgtataaccggacttgctgttgctggctgtcatgagtgtcctgtcgggagcgtataatttgtaccatatatctacactgctccctcctcttaatactcgataatcaattcgaggctgtaaatagcagctacgagtatcgagctcggcctgattcgaaggaatgggatcacctttttcgtcagtattggcaattaccaatccggttatttcaatggaaggggaggtttgccggggaggagtttgtggtattctttcctgaggggctctttcttgtatcgggttttcgcgggtatatttcgtcatgaactttttgaagtcctcaaaagttttagaatcttttgtataatatgttttggctattccacgaaaatctttgctccaggtaatgatgtttttgttattgctatgcaatttgtctgatgcgattagaatggagatatactgctcacattcttttcgggacgtttcgttaaatgtaccgtttttccagaaattggctaagaaacggacagcattccattcatctcggtccagttcattctgattctcgtataactgcgaataagtacttgcccattttttggcattttgttttaatatgatattttgagattcactgttggcaggtgtctgaagaggagccgaagagcggggtgcagaactctgatataattcctttaacgcattttggaatactaaaaatgtagtttcgtctttagtgtaatatttcctggcgatcgtacgaaactctttactccatacaataatttctttattattgctgtgtaatttatccgattgttcaagagtgcttatcaggtccatgcattcgctggtagcatccggatcaaatttttttcgccaatagtcggccagtgtctctatagcagtccattctgctgtagagagttctgtttgtttgcttttaagaaatcgacaagcttcgttccacttgccgatttccagttttaataaagtcttatccatttatagggttctgctttgttctgttttttactctactgatgctttgtcgatgattgcttttgattttctgagttcttcttcacattttacaccggtgattttgagatcgaattcaagtttatcattttctacataagctaatccgtgcaagataccttcctggtcaatctgatatgtaactgaaatctgggtaccttgaggccagtctttgctcagtttaagcgtatggtcgtcaattagtgtgcagaatctttcttccacgatactttctgtttccatatttgtgaaatcactttcaaatactttcacagatacacctcgttggttaggaatagaagtagtaaaggtttcaattcgttttgtgggtaacgaactatttgcaaaaatgaggttttgcaccatgctttgtccttcaatgattacgtcggtaccatatgttttactggtgacattgaccactgtggtacgatctccacggagaggagccggtttatcatcactttctccttcttcatagtcgcgaactgcttgtgaataggcggcattcatagcataaattgccgctcctttggctacacattcatccgggtcggttagtttggcatcacaattgaattctttatctacccgttcctttatttgtggcatgcggctgctacctcccaccaacagtatttcatcaatattattgtaacctttttctttggcaatagcaatgaccttcttggtggcatcaatcgtttcgtccagtttcctttctgtcagcgaattgaataactcacggctaatttctatacgtgcggaattgccttcatattggtaagttgctttcgctgtctgcttggctgtcaatacttttttcttgtcttctgcaagtaataacaactcatattttaggtctaatcggtcttcgaacgaataagaagtgttattttgttcgttaaaagctgccagcatatattcagctaatgcggtatcccagtctactcctcctaaatgatggtctccacctgtggctattactttaatggcaccaccgttcacattaatcagggtaacgtcaaatgttccgcctccgaggtcgtatactaaaaccgtttttttctgatctgtctttacaccgtaagagatcgcggcagccgtaggctcattgatgatagaaagtacatttaagccggctatttctccggcctgtttggtttgcatacgctctttggttccaaaataggccggacaagtgataacgacatctttgatcggttccggattatctcctaaatcgttggcatctttaaccagtttttttaagatgaaagccgaaatttctgttgggtcgtaatgatagggaaattcgtttgtgtttttatcgaaactgtcatctacacctatatggcgttttatgaatactgccgttttggtaggttcagtggccaacatacctttggcttcttttcccacgacaacatggtccatatcctcaaaatatacagcggatggagtagtggcatctccttcgaaattgcggagaacaatggcttggtcgaatttatctacttgtgcaatgcaactgtaggtggtacctaaatcgataccatatacacttctggtattgtccatagttatttatctttttagagttttttttagatgagttgattattctgattttttatatacagtgactgttgagggttgaaatattttgtttgtggtagtatttcggaagcctccgtaatgaaattctttaatagtgccggcctgttccggagtatcagtgatcactgtccggatggctgtttgctctttaggtgaatatgcgctgcctatggtcggttcaaaatactctaagtcgtattcgtcttccagaatatcttgaatatgcagtttacaattttccacttctctcaataatctcgtataagtttcaggggaactcttagcttccgtattttcataaaacttataagttttcgtgagtcgttcatgcatttttatcatgtttttcagaagaggttttacgatttccgcatgaagatcccggttatgactttgcagttcttcatgaagatccttaatgattttatctttgtaagaagaatcttccaatagtttttttaatgcatttatttgatctccgatttgagaagggaacgagtgatcgggatgcgtcgcaggctctatggagcgttcatcgtttggattcctattctccaggttctgctgccgttcttcaagttcttttgataatttatccaacttttcagcacgtagattcaactcttcttctttttgttgaagctcctggatttttaatttcatttcttcttcttgttcgggagaaagttgttcctgttcattgggggaggatgtcgcctcatcggtagctggagagggagtgtgattgggcattccggttgagattaattgagcaagattagcttcaaattggctcattctttccaatagctcttccattttgttatttttactttttggccattccatgttgtgtgtatttatagattaatatatagatttttatttctggttttacataaagtatgaatactttttattagattagataatgaataactgtgtctttttcaatcttgtctcgcaaatatatagtttgtagttgtgaaaatcaaacatattgctttataaaattgttgtaaaatgattttgtaccggatatccggtacaaaattggaattagtaaagaacctttttgatttatattgatgatcaatcatgtttttagtacattaatttaatattctatattgaatatctttaatatgctattaaggcaaaataatgagaagtatatttcacttggtattcataaaacaataggttctctttgatttattcaagtgtctttccggacgtatatccgagtatatcctgtatgtatgcgcggaatatatccggatgcatgtccggagatctgcctcttttaatgaaagaaacgggttgaagacatgaaattttaagaatcatatgcttctgttttaaggtaaaagaaaatacacttcctgaaaggaggctgaataagaggctaaaagaagaacactgtcataggataccttttcattattatttcccggaagagttgctgactcgtgaactgttggagaaggatgggaaattatctgatgaaatggaaactggagaataaatgaagaatgggttaataagtgaacgtatcctgtccacttattaacccattcgtatttcttcagattagagaattgactaattgtgtaccaatgtgccaatctcttctcctgtgattacttttttcaggttgcctaccgtatccatatcgaataccacgatgggcagattgttttccttgcacatacatgtagctgtgagatccatcactttcaatccgcgtttcaacacttcgtcgtaagtgatggtgtcgaattttgtagcagtcgggtctttttccgggtcagcagtgtagataccgtctacacgggtgcctttcagcattacgtctgcttctatctcaatgccgcggagggaagagccggtatcggtagtgaagaatggatttcctgttcctgccgacatgatcacgatttcgccgttttccatacattcgatggctttccatttgctgtaaaactcaccgatgggttccatacgtactgcggtcagtacgcgtgctttcaccccggcagcaaccaatgccgagctgagtgcaaggctgttgataacagtggccagcattcccatttggtcgccttttacccgatcgaaacctttattggctccgctcagtccgcggaagatgttgccaccaccgatgacgatacctatttgtacgccttgttcgtgaatctctttgatttgtgcggcatattcggccaatcgtttttcatcgatgccatattgcttttctcccatcaggctctcaccgctgagcttcaacaggattcttttgtattttgccatacgagttggttgttaatgatttctttttttgcaaagataaacgaatagttttaaagcgagattcttttgagagttatttttgttgcattatctttctggcgagcagtgcttgtatgaatccccgtgaagagagatagacgataaatgccatccatagagcatggttacccattgagttatgaaatgtgtaatagataatgaagaaactggccgaagctataaacatggaatagagcatttggcgtgttgcagtcgcaccaatgaagatgccgtcccaaaggaatgccgagaatccggcaagaggaatagccaatacccaatagaaataggtttctgcttcattgataacagacgcttcgttggtgagtaagccgagaaatgattgtcctcctatgccataaagtagggtgaaagcgattgaaagaccggtaccccaggcaaataatctgcggacagtgcggtgaagttctgtccggttatcggcgcctatatagcgtcctgccaatgcttcgcctgcgtaagcaaaaccatccatgatatatgagaacagagtaaaaagttgcataagtagtgtgtttacggccaggacaacttctccctgtgctgctccggcagaggtaaaatacatcgttaccgccaccaggcataaagtacgtagaaagatatcacgatttacctggaagaaacgatacatggcctgtctttgcagcaggcctttccactggatgcgttttcgcagttgtccataatatcggtgccataacaggaatgccatgaaaaagcctgcatattgggcaatcagagtacccagcgcaacgccttctactttcatacccaacagatagacaaagcataggctggctgcgatgttgactatattttgagtgatggcgatgtacatcgggaaacgggagttttgcataccgataaaccatccggcaaagccataaagccctaacatggcgggagcaccccaaatgcagatatagaaataaagtgtagcaagacgtttcacttcatcggaggtttggataaaagtaaatgccgcttttagtatgggatattgcagaagcatcaggcagagagcaatgaacagtcctacaccgaccgaccgtaataggagtcgggtcacttcgtcaagatcgcgcttgccgtatgcctgagaagtcattccactggtacccatccgcagaaaaccgaatatccaataaatgatattaaacagcatacctcccacggcaatggcaccaatgtaggctgctgaccccagatgacctacaatagtaacatcgatcagccccaataacggaacggttatattggagatgatggaagggacggctatttgcagaatccgtctgttaccactgctgagatgaaagattttatccatggacgggcaaagttacacgaaaaaaggtgaatctgaaaatgaagagaacaataacgttatttaattggtttttagcgaccggtgagtcggaataatttctatctttgtaggaacctaactaaataagtatgaataagatgaaagctctgactttatttctttccatgttgttttcgcttccgtttgcgctttcagcacaatcggcaggagaaatgctgcagagagtatcagccgccattgataataaacagtgggaacaagctattagtctgttccgtcaggccgtgaatacgaatgtggaaaaggccgagatgttttactgggccggggtggataagaatacagatgtagcctcgaagtttgctaatgagttggcttcattctataagaagtcacgcagctatgataaggcatacctgttttataaagaattgctgcaaaaatcaccgaacgatgtgaactgtttagcttcttgtggtgagatggagatttgccggggtaaggaagcagaagctttgaagacttacgagaagatattgacgctggatgcagataatctggctgctaatatctttgtcggtaactactattacctgaaggctgaacaggaaaagcagaagatagagaatgattataagaaaataaacactcctacccggatgcagtatgcccgttaccgggagggactcagccagatacttactaccggatatataaaggcaaaaggatatttagagagggtggtcagccagtttccttctactgaagcaaagaagacattagatagaataaaactgatagaaaaagaggtgaacagatagtaaggctgttcacctcttttttcttatcttcttataagtattggcaaatccaaaggaccttcggctgctgtgcgggtttgtgtctgtccttttttcggtcccggaattagtgggctgtaggtcaggacatggcggatacggttgcgctggtcatggctgaattggtcagaatagctatatgcgtaatccatgatgttatgggatgtaaatgtctgatcggtcatgcaattttctcttaaggcgagggtagacaaggcatgtactcctaaagctaattgagtgtttgaccactgatcataatattctttattgtatgtcggagtatccttacaataatccgaatcaatgcatccgtcgtaagtgccgttatcatcttcggagaacacatggtgcagacctaaataatgacctaattcgtgagccatagtaacggttacgtctgctgagttatatgagtttcccgatgattgttcatttatgtaaaggctgttaattgatacacaatagggaaactttaaattatttagcgtcaaatagggactttctaccggattgagcccttccaaaaaggtactgcctttggtagaaaagggaaggtgggcaatacctaatgttgtaaagccggaattgtcattggtaaagttgtaaatcatcacattgatatactggttaggatcccaaaggtaacttacatattttcgcgtattgtcggacataaatgcatcgcagtcgatgggataactttccggccaaagggtgtattccactcccggagtagttaaatcttttccgtcaggacccgtagaggcaagtgtaaaagtcaggttcatatctacgcttccaatcttgtttttatataatttgttgaccgtttttaatatgtcagttaaacggtttggactaatgtgctgtttggggtctgaactattcttatatagcacgtggaagattatgggaagttcatagtggtacgattcgggatcggttgaatgtccggctgccaattgtgtgacggttatgaccttttttattccactggaagttacagcaatcgttgcacttctttcagtcgtttcaaggttagcttctacaacaatgccgagtggctgatcgcttgctcccttattgggtacgagcttgcaccaggttgaagaacttgctgctacccacgaatcgctgctggtgatatttacggttagagtaattccatcgctgtcaatatcttgaaaagatgactccgacaactcaagttttgaattattttcggtattggagtcttcgcaactgacaaacagtagtgttaatatggatattaacagtaggcatctgattttcataaattaaacgtttttatatttaaaacaatattgcaaaggtaatgttttaaactaaaaaaagaagaagtattataaaatgtgctgtacctctttaaatacgtatcggcgtattttgcctgtatcgtcttgcaaaacaagatgaccgtcggcttcaacttctatggttctggctataaactctccgttcgcatcggaatacttatgcataccttcttttcggaaaagcgccttctgataccggtgggttatataagtgtgctcccctttttgaagcaggctgtaatattctataattcgttgcataactcctgccaatattctggagagttcgtaagtttggccggtgatttgtttaagtgatacaggattgggggcggggctaaaaaactcttcctggttaatattgataccaatccctgcaatgctttggctgatatgtactcccatcaaatcattttcaatcaatattccgcagatttttctttctttccagtagatatcgttcggccatttaatagagatatctttaatgtatgtgtcgagttcttccttaatggataaagagatgatttgagatagaagaaattgtctgcggatttctaaagaagtgggataaagtacgaggctgaatatcagattcttacctttctccgattcccaactgtttcctcgctgtcctctgcccaaggtttggtagttagctactaccgtggttagttcactgacatcttgcttattgcacaggtcgtttaaataatgattggtggagtctgtctcttcgatataaatcaaaggtacaggaaaagactcagggaagggcatcatattcggcacgtagttttttagtgaatttcttcaatacttcttcgtaagaatggtcaatcagctgttttatcaatttatcgtcggcatcccggtcaaagaaaacctgattccaatatttcttgttgaaatgataagcaccttcgatggctgaataatgttcacgtagttcgatggcataatcaggattacatttcaaagcaatcatattggctccttccaaatcgattagtgcgaacattttatccatcactttcagtacaagtgagtattcatcgaatgggaggcattcggtgactgcttttttctgaagacagtattctctggctgattctatattcatactatttaaaataatggcgggtaaaacgcctcttttatatgttcaattctgaaatttcctgctttacctacgacagtaataatatcaaatcttacagatgcgtctatttggaaaagcttaatatatgtatcggctgcgattacggttcgcctgattttctgtggagtaacagcatcctgaggtaatgcaaagtccgtgtcggtacgtgtctttacttccacaattatcagttcaccgttttgggctgccacaatgtccagttccagatgtcccttacgccaattccgatgacgaatggtatattcgtgctgctccagatattgaacagcagcatcttctccggcctttcctaacagattatgttctgccatatacttttagcatactattttctgcaaatttactctttttcttctttgaaattacagaagtaaaagtaaatttgcaaagaatatgagaaagagagataaaaagtgtaataaggcaactcttgacgaacctaaacgggaacgcaggatgagtatattgctaagcgaagatgagcagcagattgtagatcgttatctggataagtataagataacgaataaatcgcgttggcttcgtgaaacgattctcatgtttatacataaaaatatggaggaagattatccgactctttttggtgaacacgatatgcggcgttaagattatgttggacgattcttattttatgaaacaagctctggttgaggctgctaaggccggcgaacgtggagaagtcccagtgggagcagttgtcgtttgcaaagaacggatcattgctcgtgcacacaatctgactgaaacattgaatgacgtgacagcccatgccgaaatgcaggctattactgcggcagccaatgtccttggaggaaaatatctgaatgaatgtacgttgtatgttactgtagaaccttgtgtgatgtgtgccggtgctattgcctgggcacaaactggtaaattggtttttggtgctgaagacgaaaaaagggggtaccagagatatgctccaaagtcccttcatcccaaaactgtagttgtcaaagggatactcgccgatgaatgtgccaatctgatgaaaaatttttttgcgtctaaaagaaggtgaatttttatattatcaatcttttatctcttcataatccacatattctccttcattgtcatcaaaaagttttttgtgcttgttagctccggtttcagtaatgatttcctctttatcgttagcttgtgtcggacgatagtatctttgccccgaattactgtgtgtcgaattctggcttctggaaccggaggcagatgagcgtttccccagtccgaagatggctcttaacacacttcctacaagggccagtccgataatgataacggcgataacgataatgaataaaaatcctaaaatgtgaaacataggctatttgttttatgcattgtttaaaatttgtagtacaacaaacgtgccagaaggattgtttatttattttttcttgttaaaagtgaaagaatgatataccatacaataaccgctgagaatccgctgatacccaagaacagcaacagtggaatgcagactatcaggaatatgaaactaatcttattgtctttccaagaaagatttttaaatttcagggagaacatggggatctcagctaccagcaaccatgaaaaaagcattaccattataataaggtatataacattgcagtgagcaagtaagaattctttgcctcctacaataagtgcaccccaatataaagcgttggcagggacaggaagaccgataaaggaactcgtttggcgttcgtctacattaaagttggccaaacggagagctgagaatatcgaaataagaaaagccagataaggaatatactcttttacgcctgccagaaagtcgggatacataagtccgggttctttcatgaatgaaaaaacaagtatggccggagctacgccgaaactgacatcatcggccaaagagtccaattctttaccaataggagagtaggcatgaagcaaacgtgccaacataccatcgaaaaaatcgaagacagcactcaagatgataaaagtgacagccaattcgtatttggcttcaaaggccataacacaagcaatgcatcctgaaaatagattcaggcaggtcactgtgttgggtatatggcggataatagcatttgccattgttcgttttttattttaatttggcgataacggtttggttaccggttgtcaattgtcccatactaacacaaatctcagtgcccaatggcagatatacatctacacgggaaccaaatttaataaagcccagatgttcgtcaatataacattcctcacccggctcggcatatgttacgatgcggcgtgccattgcaccggctatttgccgtgccatgacctctacaccctcgggagtttcaataacaaccattgaacgctcgttctctgtgctggctttcggaagccatgctttcatgaacttgccgttttcgtgagagacttttttgacgactccatccaccgggtaccaattggcatgtacgtttagaatgctcatgaaaatggataccatgatccggcggtcatgaaagtattcatgttcgtctacctcttcaataactacgattttcccatcggccggtgcaactacgatcctttcagtatcttgtccgaacaggcggatcgggcaacggaaaaagttaaccatcaacagatagactataacactgaccagagccatcaggtagaatggtattttacaatcaattccccagtaaagggctgcatttataattagtagcagaaaaaagctaccccataaaatatgtgttccttcacggtgaattcttatcttttttaattttttaagtcgacccatttgcgctatttaatgataattatccgcaaaagtatacttattttaaaaatccagcaagcatttgcagatagaaatgacttatgttgataactttttggagtttatctttgttagtagctacagacattgtaattttatggcttcaaattatcaacctataactatgcaggatttcgttcatttacacgtccatacgcaatattctcttctggatggtcaagccagtgtcagtgcgcttgtcgataaggccataaaggatggaatgaaaggtattgccgttacggaccatggaaacatgttcgccatcaaagagtttacgaactatgtgaataagaaaaacggggggccgaaaggagaaatcaaggacctgaagaaacggattgcagccattgaggccggtgaagtggactgtgcggataaagaggctgagattgctgattgtaaagctaaaatagtggaggcggaggggcggttgttcaagcccattatcggttgcgaaatgtacgtggcccgccggactatggataaaaaggaaggaaaacccgatcaaagcgggtaccacctgattgtgctcgccaaaaacgagaaggggtatcataacctgatcaaattggtttcacgtgcatggaccaaaggctattatatgcgcccccgtacagacaggaatgaattggagaaatatcatgagggcttgattatctgttcggcatgtttgggtggtgaagttcccaaaaagataactcagggattgttggcggaggcagaggaagctattcaatggtataagaatctgtttggggacgattattatctggaaatgcagcgtcataaagcaacggtgccgaaagctaatcatgaagcatatccattgcaggtgaatgtaaataagcatttgatagaatacgccaaaaagtataatgtcaagttgatttgtacaaatgatgttcattttgtcaacgaagagcatgctgaagcccatgaccggctaatctgtctgagtacgggaaaagaccttgatgatcccaaccggatgtattacactaagcaggaatggatgaaaacgaaagcagagatgaacgagctctttgccgacgtgcctgaagcattaagtaatactttagaaattctggataaggtagaatattattcgatcgatcatgcaccgattatgcctacttttgctattccggaggatttcggaacagaagaagggtatcggcaaaaatatacggaaaaggatctttttgatgaattcactcaagacgaaaatggcaacgtggtgttgagtgaagaagcagctaaagataaaataaaacgtttgggaggatatgataaactgtatcgtatcaagttggaggccgattacctgaagaagttgactttcgacggagccaagaagttttatggcgatccgttgtcaccggaagtaaaggaacgcttggtctttgagttacatattatgaagacgatgggttttccgggctacttcctcattgtgcaggacttcattgctgccggacgtaatatgggggtatccattggaccgggacgtggttcggctgctgggtcagccgtggcctattgtttgcagatcaccaaaatagaccctattaaatacgatttgctgtttgagcgttttctgaatcccgaccgtatttcattgccggatattgatattgacttcgatgacgatggtcgtggcgaagtgcttcgttgggtgacggagaagtatgggcaggagaaggtagcacatatcattacatatggtactatggcaacaaagctggctatcaaagatgttgcacgtgtacaaaagcttccgcttgccgaatcggatcgtttggccaaactggttcctgataaaattcctgataaaaaactgaacttaaagaatgccatagaatatgtgcccgaattgcaggctgccgaagcgtcacctgatccattggtaagggatacgatgaaatatgccaaaatgcttgagggaaacgtgcggggaaccggtgtacatgcctgtggtaccattatttgccgtgatgatattactgactgggtgccggtcagtacggctgatgataaggagaccggcgaaaagatgctggttacccaatatgaaggttcggtgattgaagataccggactgattaagatggactttctggggctgaagactttgtctattatcaaagaagccgtcgaaaacatccgtctgagtaaaggcatggaactggatattgattctatttcaattgaggatcctgcaacttataaactttatagtgatggacggactatcggtacattccagtttgaatctgccggtatgcagaaatacttacgtgagttgcagccatctacatttgaggatctgatcgcgatgaatgccctttatcgtccgggtccaatggactatattcctgactttatcgaccgtaaacatggacgtaagcctattgaatatgacattcctgtcatggagaaatacctgaaggatacgtatggaattacggtttatcaggaacaggtcatgcttctgtcacgccttttagccgattttacccgtggtgagtcggatgccctccgtaaagcgatgggtaagaaactgcgtgataagctggatcacatgaaacctaagtttgttgaaggtggaaggaaaaacggccacgatccgaaggtacttgagaaaatctgggcggactgggagaagtttgcttcgtatgcgttcaataaatcacatgctacctgttattcctgggttgcataccagacagcatacctgaaggctaactatccggctgaatatatggcagctgtcatgagccgaagtttgtcgaatattactgatatcaccaaactgatggacgagtgcaaagcaatgggagtgcagacgcttggtccggatgtgaacgaaagtaacctgaagtttacggcaaaccggaatggaaatatccgcttcgggctgggggctgtaaagggagtaggtgaagctgctgtgcaaagcatcatggaggaacgaagggaaaatggtccttttaaaggtattttcgacttcgttcagcgtgtcaatttgaatgcttgtaataagaagaacatggagtgtctggctcttgcgggcggattcgatagttttcctgagctgaaacgtgaacagtattttgcggtgaatgccaaaggcgaaacttttcttgaaacattgatgcgttatggtaaccgttatcaggcggataaagctgctgccgttaattcattattcggaggagacaatgtgattgacatagcgactcccgaaattcttccggcagaacgttggaatgatttggagaggttaaataaagaaagagaattggtcggtatctacttgtcggctcatccgcttgatgaatatgccattgtgttggaacatgtatgcaatacccgtatgatcgaacttgatgataaagctgctttggcaggaagagaaataacgatgggaggtattgttaccagcgtgcgtcgaggtataagtaagaatggtaatccttatggcatagccaaaatagaagattactccggttctgccgagatacctttcttcggaaacgattgggttacttttcaaggctatttaggtgaagggacttttctgtttatcaaagctcgttgccagcctaaacaatggcgtcccgatgaacttgatattaagattacttcgatggaattgctgcccgacgtcaaggaacaactggtagagaagatcacaattctgattccgcttgccgaacttaattcgaacttggttacggaacttgccactttgacgaaagagtctccgggaaatacagaactttattttaaggtaacagatacggatggaaagatgtatgtagacttgatttctcgtcccgttaaactttcggtaggtagagaattaatttcctatttaaaggaacgtcccgaacttgcgtttcatataaattgattatctttgccccataacagtgatggatacttaataactaacaattaataattaaagaaatggctttagagattactgacaacaactttaaggaaatccttgcaaaaggaacaccggttgttattgacttttgggctccctggtgcgggccttgtaagatggtaggtcctatcatcgacgagttagctaaagaatatgaaggaagagtgattatgggtaagtgtgatgtagatgaaaactctgatcttcctgcagaattcggtattcgtaacattcctacggtgcttttcttcaaagacggagcattagtggataaacaagtcggtgccgtagctaaacctgcattcgtagagaaagttgagaaattattataatatactttcattaaaaatatttgtttatgggactggaagacgattttttgttaagtgatgccgatgatgaaaagaccatcgagttcatccggaactatttgcctcaggagttgaaggataaattctcagaagacgagttatattatttcctcgatctgatcgatgagtattactctgaaagcggaatccttgatgctcagcccgatgctgacggttatgtagacatcgatctggagcaggtagtggaatatatcgtgcaagaagccaagaaagatgaagtgggtgaatatgacccagaagaaatcttgtttgtggtgcagggagaaatggaatacggaaattctctgggacaggtggaataagccagtcctcgtaaaccaaaagataaagagcgtgcagaaacacttctgcacgctcttttgttgcatgtatgtgtgatagtttacttcgtcttgattcttctcctcctgctaaaaatacattttgtttttcggccctcggaagtatcggatgtgtataggagtccggatatctgcctgaaaataggatgaataaaagtccggcttactctgtttttacgaaataagatctactaaatttcttctaacgcatagtattggtagtctcttacaacggtttgaagaaacttttcatcatttacgtctgtttggtctacagaaagcagtgcacgaactttgggtgccaattgtgagatatgccttgcccggtccttatgatgcagttctaacgccttactgatcacatttatttgctccaaggacagatcggcagctaatggaaaactggggtgatatcctttggtcagataatcgaactcatcaaggcttacttgtattttgcggtaatttttctctttaattaccattgttcctgccgcaagatcacccaaacgttggctgtttttggttaatagtatgaccagtacccccaatcctccggtaatagttacgtctatcccatagagcaaccaccttagcagatatgcactcaggctgggtgtcgtaccgtctgcttttaccacacggatattcatgaccttttttccgatactttgtccttggttaaaaacttcgcaaagtaacgagtaacatagtacgggcagatagataaacaggaacaacaagaaaaaagtacttccggaaaaagcgtgtatattgagtttccccaatacataagaagtggcaagaatgtaaataaacagcaggaaataatcgatgatacgagccagtatccgttcgccaaggctggcgggtacttggctgatgcgtacgaattgtcctgtgatgatagtcgattctgccatttctggttaaacattttttggtttcggttgcaaatatatcataattctcttacttttgcttccggtttcggacaaaacttatccggaattcaacgagttaaatgaaagaggtaacgtttatacgtcggaacattgaaaaatggaaagagacagagaaggtggtggagcaggcagataaactgactcccgaccgtcttgccgatgcttatacggaacttactgccgatctggcatttgcgcaaactcattatccgtcttcccgcattactatttatctgaataacctggcttcggccctccataatgtgctttatcgcaataagaaggagaaatggacccgtatttttactttctggacacaagaggttccacaaacgatgtactatgctcgtaaagagctgttgatttcggccctgatctttttggccagtgtattggtgggtattgtttcagcagcgaatgatgataacttcgtccgtctgattctggggaatggttatgtggatatgacgctcgataacatagcgcgtggtgaaccgatggctgtatacaacggttcggatgaagttcctatgtttttgggcattactttgaataatatcatggtttctttcaatgtctttgctatggggttgcttaccagttttgggacaggatggttactttttaataacggagtaatgctcggggcctttcagaccttcttttttaagcatggcctgttgggagaatcgatgcttgctgtctggctgcatggaactttggaaatctgggctattatcgtagccggtgccgcgggattggcattgggaaacggatggctgtttcccgggacttactcccgcaaagagtcttttatgcgcggagccaagaaaggactaaagattatagtgggtacggttcctgtctttgttatggccggattcattgaggggtttatcacacgccatactgaattgcctgactttctgcggttgagcattattcttttatcactggcatttattatctattactatatttatttaccaaatagaaaaaatcatggaatcacaaaaacctaaaattgctttatatgtgaagcggccttttggtgacaaactcaatgccaccatggactttataaaagagaactggaagccgatgttgaagttcagtacctatttgattctgccattatgtctgattcaggctatcagcatgaatggaatcatggggggaacaatgggctttgcagctgccaaagagaccggagccaatcctctggaagcgataggtgcacaattttgggtcaattacggattgatgtttctttgttatttggtaggatctattttactgacttccattgtttacggattgatgcagatttataatcagcgtgaagaacgtttggcaggtgtcacttttgccgatctgaagccttttctgttcaagaatataaaacgtctgctggttatggtactgttttatatagttctgattatagcagtgagtattgttatagggattctggttgcagcttctccattcacgcttttgcttactattccgctgctgattgcctgtgcagtgcctttggccttgtttactccaatttacttatttgaggagatcggcatctttgctgctttccagaaaactttccgtctggggtttgccacatggggaggtgtttttggcgtttccttggtcatgggattgatctccagtgtattgcagggcgttactacgactccgtggtacattgctactattgtgaaatacttctttatgttgagcgatacacagaatgagttaactatttccgccggatatagttttatggtctatctgctggccattatccaaacttttggagcctatctttctatgatattttctttaattggtatagtatatcaatatgggcatgccagtgaagtggtagacagtatttcggtagaaagcgagatagataaatttgagcaactttgattaaactttttggatgactttgcaagctgatactctggtctgtgataccgcaagagttgccttttggcagtccaatccggcttatgactacaaccgggaactgataacacctgagatcgatgtcttcggctggctcagtatgcagctttctaagttactgcgcgccattttcggaagtcgttttgcggaggaatattccggtattattctggttgtcattgccattctgatcttgttgttgattctttggtttgtttataaaaaacgtcccgagctttttatgcgttcacgcagggggcctgtgaactacagtgtccatgaagatactatttacggggttgattttgactctgagataaagcgtgccatggaacgtaaagattaccgggaatccattcgtttgctttatttgcaaaccttgaaactattgagtgatgaggggcggatagactggcagccctataaaactcctacagaatatatttatgaggtaaaacaggaagcacttcgcagctctttcaggcgtttgacaaatggtttcctgagggtgcgttatggcaattttgctgcatccgagccactatttgaggaattgttgtccttgcaaaccgagatatggaaaggaggtatcgaatgagaggtagccgctggtttatcattgggatagttctctttttgctgatcatgtttgtggttgagtatcatctgccgaagaaatttgtctggaacccgactttcgggcaacatgatcaccagccattgggaggggctgtatttgatgatgttttaaagtcttcgcttccggatggatattcactttcgcgcaagacattctatcagtttgctgctgacagcagcccccggaaaagtattcttgtcgttacccagcatctggatttggtgaaggcggatgtcagtgctttactcgatctggcccgtaggggaaacaagatattgatagccagttcctcttttagtccgttactggctgatacattgggattcaataattcgtatgcttatttcaatccgaggcggttaaaagaatatgcagccgatctgttggaacgtgacagtgtgttctggatcggtgattcggcggtatacgataagcgtactttccgtttttatccgcatttatgcggtatttatttcacgaagtatgattcgttgtctctgccgttggctacgagccggatcgattccatgcagatgttcaatgacagtttaccggattgctttccgcctgtggctatcagccgtccgttcgggaggggagagattgtcttggtcaccacgcctttgctgttcactaactatgggatgctcgatggcgataatgcagcctatcttttccgtttgctttcacatctgaaagggttgcccgtaattcgtaccgaggcttatggtgccggtgcgcagattgaagaatctcctttccgctactttctttcccaacgtcctctgaagtgggcactctatctgacaatgtcagtattggtgctgttcatggtgtttactgcccgtaggaggcaaaggcccattccggtaattcgtgagccggccaaccgtaaccttgagtttacggagttgattggcatactttattatcaaaaaaagaatcatgcagatcttgtacgtaaaaagttcacttattttgccgagagcttgcggcggaacatacaggtggatgtagaagatgacggtaatgatgatgtcttgtgcagccggattgcgcggaagacgggaaatgaagaggtgaaagtccgaaatcttttccgtaaacttcgtcctgtggtacgtggagaacaggagaccggagagacattgatgaaagacctgattgatggaatgaatgagatagaaaagcctcgatcttgatcctttggcggaggaagaatagctggaaagaaaagaaatatgaatttgataaataaaaagaatatggaagaaaatatgaatgatatgcatggagaagaagctccgcgtactgatttgactcttttttcagagaagatacaggaactgaaaagtcagattgcttccgttattgtggggcaggaacgtactgtcgacctggtgttgacggctattcttgctaacggtcacgttttgatagaaggagtgccgggagtagccaagaccttacttgcccgtcttactgcgcgcctgatagatgctgatttcagccgtgtacagtttactcccgacctgatgccgagtgatgttctgggtacgaccgtcttcaatatgaaaaccaatgaatttgattttcatcggggacctgtctttgctaatgttatattagtggatgaaatcaatcgtgctcctgccaaaacccagtctgccctttttgaagtaatggaagaacgtcaagccagcattgacggaacgacttaccggatgggagaactttataccattctggctacacagaatcctgtggagcaggaaggaacctataagttacccgaggcccagcttgaccgtttcctgatgaagattaccatggattatccgtcgcttgaagaagaagtcagcattctggaacgccaccataccaatgctgcattggtgaaattagaggagataaagccggtgattaccagtgaggagctgctttctcttcgccggctgatgggaaaggtatttgtggatcagactctgcttcagtacattgctttgattgcccaacagacccgtaccagtaaagctgtttatttgggagcctctccccgtgcttcagtagctatgttgcagtctgccaaagcttatgcacttttgcaggggcgtgattttgtgactccggaagacattaagtttgtggctccctacgttttgcagcatcgcctgattctgacggcagaagccgaaatggaaggatattcgccagtcaaggtaacccagcgcttgattgataaagtggaagtacctaaataattatgttcctgaccaaacgtttttacatattcgtccttgtcgtcatcctgttgttaggtggcggatatctgttcggctctatgttcatcatcgggcagttagggttggttgcgctattgctcgccctggccttcgacgggtatctgttgtatcgtaccaacggtatccgggccttccgtcaatgcgccgggcgtttctctaacggagatgataatgatgtcagtttacgtatcgaaagccgttatccctatcccgtgaatctggtagtgatcgatgaagtgcccgtcatatttcaacagagagacgttcattttgaactgtctcttaagcctaacgaagggaagacagtgacatatcaactacgtccgacccataggggagaatacggtttcggatctattcgtgtcttctcaaccacccggatcggattaatatcccgaaggtttacgtgtggtaagtccgaaaccgtcaaagtatacccctcttacctgatgcttcatcaatatgaattgctggcgataagtgataatctgaccgaattaggcatcaagcgtattcgtcgggcaggacatcagacggaattcgaacagatcaaagaatacgtaaaaggagatgattaccgtactataaactggaaggccagtgcacgccgccatcagttgatggtcaatgtttatcaggacgagcgcagtcagcagatatacagcgtgattgataaagggcgtgtgatgcagcaggcttttcgtggtatgacgttgctggactatgccatcaacgcctctttggtgctttcgtatgtagccatgcgaaaagacgataaagccgggttggtgacgttcaacgagcattttgatacgttcgtccctgcttccaagcaagtcggacaaatgcagactcttcttgagaatctctataaacaggaaacaacgtttggtgaaacggacttttccgccctttgtgtgcatttagggaagcatgtgaataaacgcagctttctgatgctctataccaatttcagtaacatgaccagcctgaaccggcaactggtttacctgcaacaactggccagacaacacagagtgttggttgtattctttgaggatgccgacctgaaagaatatattgccgggaaaccggagacaaccgaaggatattaccaacatgttatcgcagagaagtttgcgtttgagaagcgactgattgtgtctactttgaagcagcatggcatttattcgctgcttacaactcctgataaactgtcaattgatgtgatcaacaaatatctggaaatgaaatcccgtcagttactctgatacaggttgcgtattgaggaagaagaagacagccatacctatcatgatgattcccagcagtccgtaaaacagccgggcgcgttttctgcctacattccgtacaatcagttgtgcattttgggcagtgaaaaaccagttccagttgagtatagatgccagcagggcggtaagccctgcgatggcaaatattccctgaacaaaatattgaggggccattgctcggatgattagtcgttaatcactatttttcttgttccatcctcaagttcctcgatggtaacctttacggcgtctcccggcaacagttcttctaccagttccggccattcgatgaaacaaagtgcaccactgtagaagtaatcttcataccccatgtcatatacttcgctcaactttttgatccggtagaagtcgaagtgataaatcagctctccgccttcgtccgaacggtattcgttaacaatggcaaaagttggggaagtgataacatccgacaccccaagctcttcgcaaagtgccttgacgaaagtcgttttacctgcccccatctttccatagagtgcaaagactgtgttatcgcccatgacagagatgaactcgcgggcagcttcgtgaatctgttccagtgattgaatcttgatttccatacttatatgttgtttttattgtttctttctgaaaaggctctttcctattttacatgcaatgtagataagaatagagaagaaaatgatggatgctcccgaaggcacattcaggcggtaagagatcagcagacctcccaggcaactcaggtaaccgatggcaatcgacagccagatgatgcgtttaaacttgttggtaaacagattggccgtcatctgtgggatggtcagcaacgaaatagccagtacaatccccaccatgcgcagacaggaaacgatggtaagggcgatgaacatcatcaggatatattccaatactactaccgggattccttgtgaacgggcaaactcacggtcgaaagcgatgtatataatcgggtggatgaacaaggtgaagaacaggattagcaggatggcaagaatacccagcatcagcaagtcggtctgtgtaatggtgaggatattgccaaacaggtaggccgaaagatcgggagcgaaacccggggacagaaaactgaacatgattcccaatgccatacccagtgtccagaacatggcaatggccgaatcttcacgcatgtcttttcgtttgctgagccactctactccgaaagccgataagacggaaaagacggctgccgaaagaatgggagagaggccggtatacagtcccagtccaatgccgccgaatgaggcatgggtgatacctccgctgataaataccaggcggcgagtgacgatatacgtaccgataatgccacaggcaatgcttgccagaagacttcccaggagagcgtgttgaaaaaaggtatattgtagtaaatccatacggttcagctgttaggaacgtgaggcagacgggcgggttaaggatgtatcctccgttcgcctactaccagaaagacttcatcttttatttcatcgggaaggctgattcctctcagttgcaggctgcgtacccatccggctacatcggtgtcttgcatggtataaaagacatcacggaatttatcagcttcttccggtgtatattcttcgggggccctgccgataaatgtatccagttcttcgtcgtcgtaatactctatttgcttactgacggcagccagcaaactgtcccgttcacaaacttcatgctgtccgcaacactctacgtcgacttcctttacttccgggaagctgtccagttctccgttatctattttcttttgcagccttttgttgcggatatacccggcaatcattgccacgatggcgagcaacaccagaccaactataagtatccacataattacgaatcaaattttcgcaaaggtacttattaatttgtattattccgtatatttgtccttgcaatgtgctaaatgaactaaaacagaaacatcccgatcatgaaaagaaaacacctgattactgtctttatgtggtgtgtcgccactactttgtgtgcccagaccccggtcgaaaaggggctgaaaagtattaaccgtcaggctgccgaggcttatatcggctttttggccgatgatgaattacagggacgtgaagccggattccacggttcgcgtgtggctgcccggtacatcgtttccctactgaaagagatgggagtccgcccgttgggtgaaagctactatcagccgttcgatgcttatcgcaaggaacgccagcagaagggacgtctggaagtgcatccggactcgatagccaaactgaaacaagtggtacatcagaaactgtcaatgaataatgtattgggtatgattcccggaaagaagacggatgagtatgtgattgtcggtgcgcattttgaccatttgggtattgatcctgccctggacggtgaccagatttacaatggtgccgatgataacgcttccggagtatcggccgtactgcaaatagccaaggcttttgtggcaagtggccagcagccggaacggaatgtgatctttgccttttgggacggagaggagaagggactcctcggatcgaaatactttgtgcaggagtgtccgttcatcaagcagataaaaggatatctgaattttgatatgattggtcgtaacaataatccccaacagcctaagcatgtggtttatttctataccgaggccaatccttctttcggccgctggttgaaggaagacattaaaaagtacggtttacagttggaacccaattatcgtccttgggacaaaccggtgggaggaagtgacaacggatcgtttgccaaagtcggtattcccatcatctggtatcatacggatggacatcccgattaccatcaaccttccgatcatgccgaccgcttgaattgggataaagtggttgaaatatctaaagcctctttccttaatgtctggaatctggcaaacgaaaaggattattaagaatgaaatgaaaactaaactaactaattgtgtaagaatcggattgctctcttttatgttggggtgtttgcttacttgttgccaaggaacggctccttccggcaatacaggtaaaaaaacttccagaacggctattgcgtccaatgactcagtgaagttgattcccgataaagtcttgaatgacgcgtcttgtgtgcttgccggcttgccggttgataaagaaagcgggaagctttatgccctgacccagacgaaagaatggaagaaccatgcccgttacatggatcagatatggaacgtttttcagcagacggctccccgcgtggtagctttctcacagacggaactggaagatatcaacgcccgttgccatacactgttctatccgtttggggggcctgactttctgtttgccaatgcattctttccagaaatggatacttatgtgctgatcggattggaacccgccggtagtgcgccgaaggtgaaacacccttctgccgaaacctaccgtttgtatcaaaacgctgtgtcggatgtactcaacctgagtttttttaatgatatggacaaagagttggccaatgataccattgacggggtagttcccatctattcgttgttgatggccaggggaaacaggaagatagtcagtattaaggaggtccggttatcagaagccggagatcttattgaagtcgggaaaggagataccatccggaatggagattgtacgggaatggaagtttgttttttccgtccgggcacttcccggttacagactctttattatttctgtaccgatatcagtaacgaggggttgcaagccaataagcctttacaggcatttatggaccgttttgatacggaggctaccgcaacattcgtcaagtcggcttcgtacctgatgcatgagccttctttttcccgtatacgtgaaacgattctcaggaaatcatctgccgtaatacaagacgactcttccatcccgttgtcctgtttcgacccggagatgtggacggttactttgtacggtaccttttataaacccatttcagctttctcgcaatattctcagccggagttgcgagatacctatcagttgggcgatcccaagcccctgaacttccggatcggttatgcacggcaatccaatttgcaggttgtaagaagaaaataatcccggttaatgacttttctccggagggttaaccgggaattaaccctccttctaacccttcctcattagcttcgcagcataaattaaatgcaaagggtaaataagcctttaccctgtttaaaattcaatttctgagctatgaggaagaatatttcgattacccttatcgttagtgcagcccttttgttggcttcgtgtacacaacaaaaagtacctttcagtcctgtcgattatgtaaatcccctgatgggaacagagtctacttatgccttttcgcatgggaacacctatcctgccgtagcagttccctggggaatgaatttctggagtccgcaaaccggggagaatcgaagtggctggatgtatatgtacaccgacagcctgatacggggattccgccagacccaccaacccagtccgtggataaacgattacggaactttctctatcatgccgttgtccggcgaactgaagctgaatcataaagaacgggccgtgcctttctcacacactcaggagaaagcgactccttatagttatggtgtcacgtttgcggatggtacccggacggaactttccgcgacttcgcgcggagcggtatttgaagtttctttcccggagaagtccgaccaatatattgtggtagatgcttatgatggtggaagtgctctggcgattgacaaggagaatcggtgtgtaaccggtgtggcacgtaatcataatggcggagtacccgataattttgccaactatttccggatagagttcagccatcccattacagaagaaggagtatacgacggggatacgctgatgcatcaccaacagacggtagagggtgattatacctgtgcttacctcaagtttgacgttccggcgggggaaaggctgaccgtccgtacggcatcttcttttataagtccctcacaggcacttatcaacttcagccgggaagtgggaggaaagagccttgcccaggtgaaggaagaagcacgaaaacagtggaacagctatctgggacgaattgaagcggaaggcggcagtgaagagcagctacgcaccttctattcctgtctttaccggacattgctcttcccccgtgagttctatgagttcgatgctcaggggaaaccggtttattacagtccttataacggaaaaatacacgatggctacatgtataccgacaatggcttttgggatacgttccgtgcagtccatcccttgttcaccttattatatccggaggtttctgaaagggttacccagtccattctcaatgcttacgatgaaagtggctttatgcccgagtgggcaagtcccggccaccgtggatgtatgattggcaataactccatctctttgttgacagacgcttgggcaaaagggattcgtaccattaatccggagaaagctcttgaagcgatgatccatcagactggggccgtgcatccggagatcagttcggtgggccgtgacggatttgaatattatgatcgtttaggttatgttccttatcccgaagtgcatgaggctaccgctaaaacccttgaatatgcgtatgccgactggtgtgtagcgcgctttgccgcttccatcgggaagaaggagattaccgacagttattatcgcaagtccttgaattaccggaatctttattatcccgaacatggctttatgtgggtgaaagatgcccaagggcggtggagggaccgctttgatgcaacagaatggggaggtcccttcacagaaggaagttcctggcactggacctggagcgttcttcacgatcccgaagggctgtcgcaactgatgggagggcacgcatcgatggcaacccgcctcgattccatgtttacagctcccaacacctacaattacggcacctatggttttgttatccacgagatagccgagatggtagccctcgatatgggacaatatgcacatggtaaccagccggtgcaacatgccatttatttatacgattatatcggcaggccctggaagacccagcaacatgttcgcgaagtgatggggaaactctataactccggcagcaaaggctactgtggtgatgaggataacggacagacttctgcctggtatgtcttctcggccatgggattctatcctgtttgtcccggtgtgccggaatatgcgatggggagtccgcttttccctaaactgacgctacacttgccccatggaaaaaatttcattgtgaaggcagagggaaacagtcccgcaaactgctatatcggaaaagccttgctcaatggcagcgagtttacccgtaatttcctgactcaccgtgaacttatttccggaggagaactggtattatccatggatagtgtgcccgatctccgccgtggcaccctgaagacggatctgccttactcttactcccgggggctatacgtttgccatttctattatttttcgtatttttgttgcactatggaacggatgacgcatttatcgaagaacagtatatgagaaggttgagatgtttgtttgctatcggaatgatatggctttgtatagccgattgtttcccgcagggacttcttttctatggaaatgagaagcggatcagtgagcgtgccacttattctgtcctgcgcgaggaacatcagcgtacctttaccaacaccttctgcatctcttttgactatctggtacggaatgtggagagtcccggttatatcctttatctggaagaccgggatgccggaaagacctatagcttcacctatcttcataaacccggtgaccgctgttctttttcttttaacgaagacggcaaacgtatcttttgtacttttgaactgaataaagaagattatgaccatcgttggttgcccgtctccattgcgctggacatacacaaagaccaggcccggataaccgttggcagccaaagcaaagagatctctaatctgggattggagaaaggcggcttctctccgcatatttatttcggtaaatgtgaatacattctggacgtggcttcgtatgccatccgtaacctgtcgcttaccgacggagaagagatcatgatattccctttgaacgagagtagcggagaagatgtacacgacagccggggacatgttgtgggacgggttaccaaccccatgtggcttatcaatcagtcctactattggaaagagctttttacggattactcttccacaccctccggtctgaactttgacaaaacacatcaggagattcttttctttaatcaggactctctgtctacgttcaacctctatacccacgaattgttgcaggtgccttataagaatcctttgccggttcagcttcgtctgggtatgaacttcctggatgaggcttcccgcgaactgtatacctacgaagtagccgactcgcacggtgatgccatggtggcggcactcgatctttccaccaacgagtggcgttcagccagtaccgattatctttgccagcaactccatcatcatagcggattctttcatccggccgaaaagaaattctttctgtttggcggttacggaagccgcaggtatagcaatacgtttcttgcatacgacctgaaaacttgccgctgggatacactgactttctcgggcgaccgggtaactccccgctatttttccggtatggccgtcagccgcgattacaaacgggtttacctttatggaggcatgggcaatgaagccggtgatcagaatgtgggacgcaactatctgtacgatctctaccgggtggatatggacacccgttcggtacggaaactctgggaagtgaaagcaccggcggtcaaccgggtggtcccccgcaatatgatactctctgccgatgaaaaatacctgttcctgttggggtatccggaatatctgcccaattccactttgcaactgtaccgtttgtccgtccgtgacggagagtgtgaagtggtgggagacagcattcccattgtttcggaagagattgccaccaatgccaatctttatttcaatgaagaactcggcgagttctactgctctgttcaggagttcgagaagcacggtcaggtgactacccgcctctattctctggccgctccgccggtgactctggccgatgtggaatattacagccggatgcggaccactctgaacaacaggctgaccgggggaatcgttggcggggtattgctcttgatggcctgtgtatggggaatcatacgttacaggcggaaacggaatgcggcatccccggaggaaacatctgccggggttcttcccgaaagagggcagagtgccccggaactttcggttatggagctgcctgagatcgaggaatccgaacttggaaaagaaccttctgagtgggatgagttgccggctgtattgccgcccgataagaatgcgatttttctttttggtatgtttaccatacttgacaatgccgggcgtgatataacttatatgctcagtcctaagctgcgtgttctctttttatatattctgttgaacagtgtggggaagagaggggtgctttcatcggatatgaataagatattctggccggataaacccgatagtaacgtgaagaacctgaagggagtagccatgaatcatctgagaaagatattgcaggatgtagacggtatcgagcttgtattccgcaacggatacttctgcctggtgtttggcgaagagttctattgcgattatatccgtctgattgctcttacttctcccgaaaagaaaaagaaggagagtcccggtgccatccgtgccgaatggttggaaatacttctgcggggcaagttcatatctactgtcgaatccgatctcttcgattattataaacaaaaggtggaatctctgattcattctctgctgcccgaacagctggaacttgcttacaaagatgcccggttcagtatcgtcatccgtctttgtaacatccttttcatagccgatcctttgtcggatatggcacttgcctacacggtttgcgcccttcggaaacagaataatccggaagaggccatcaggcgttatgccgcgtttacaaaggattataagcggatgatgaacgaggaatacagcattgctttcgccgacatcaaagtttaagtattgtcccgttgccaatttgtcaaaatgctaacgaaagcctcccggttttcgttatttcggccattggacaaggagggggcgaaaaaacgccgccatttagtttgtctgtttatctttccggcagtaattctgcctgttttcaatcagtggagaaacgtaagcgatgccatcccgtaccgcctgtccgcttaatggtggaatacctgtcctttcgatacttcgtgaagccttctcccggtcatccaaccagaagtaaaatagttcccgtagaccctctgtctccgtaacaatatatgttatcgaccaaaactgacttcatacagaaatcctatacacgttttaacacaaatagccctatcaatgaattcattgatagggctatttgtgttaaaacgtgtataggatttctgtatgaagtcactccaatctcggaagcccggctctctggctccaaaagccttcgtttggctttcttcttctctccgaacattggaaacggacaagggctctgttataaaaaacggatgtttgctttctttttgcaccgttattcggcgaatggataacatccggttgattgctcagagcgaacagtcggctttgtcgtccggaacggaaattagctgaccaagggaactgatgattctgtcgtagggataagcctgaaactcttcggcagtggtcataccgctggtaacgccggcaaaagaaactccggcagcagcggccgttcctgcatccactgtactgtcaccgatgtataatacttcttcggggcatgccttcaatcggccgatggcaagtaacaaaccttcaggatcgggtttatgatgtgtcacatcttcacctccgataatgatgtcaagccaatcatccggcatgtgatttttcaggaaactcagtatccggaaccggtatttggttgaaatgattccgatacgggccccttgttttttcaggtacgtaagcgtggggagagtatccgggaaaaggatggtgtttgcattcatatatacatctgcctcttttgaatactcttgtctgaatgcttccagttgactggcatcagtaattcctgtaaggatgctgaatgattcttcaagcgttttcccaatggtacgtttaatggtatcatcggtgacaccggtgtagccgtgtctcttgagcacgcttctgaagcaggttacgataccgcgtgaagagtctgctaacgtatagtcaaagtcgaataaataaaccgtgtatttcatttgcggaattttcggcaaagatagtgatttttttatttcaataaagcttatttgcgcactctgcctcccgatatccaatgggtccggtaatagggttcgttgaggctgctgacaattaccccttggctggtgctggcatgaacaaactttccatccttgagatagatgcccacgtgggccacttttctgcgcgatttccggctgctaaaaaataccagatcaccttcccgaagattccgccgggcaactttgttactctctttcttctggccgtctgtacttcgttgcagtttgatgtgatacacctttttataaatctggcaagtcattcccgagcagtcagtaccacgtttcgtctccccacctccccggtaaggggtgcctatccactgggccgcctccagataaagtttgtgattatcttccattccgatatccacacccaggcgtacagaggcgcgggcgagtgccttataatcaagtctggggacagaagtgcggcaagcactcaggctgacaaccaaagcagtaaggagcaacagattaaaaagatgtctcttcatacgttttttattcttctacattaaagtaatcttccagttctttttcagccgaattattctcgttcacaatgtcacggatgataattccgtgttcaagtactgcgatgcggggacaaacatccaccgtgtggttcagattatggctcgaaatgatgactgtggcattatgttcttcattatactttttcagcaggtgcttgattacggattgcgaactcggatcgagaaagttgaatggttcatccaaaattatcaatttgggataatgcaacatggccgatatgattcctattttttgcttatttcccgcggaaaaattacggataaacttcttttgccccagtacttctccgttcataaaacgttcgaaagggatcaaacgttcatccacctcctcttttttcagtccatacattttgccgatgaaatagaaatactcctccggagtcaggtagccgatcagaaagccatcatcgataaatgcaccggtgaaacttttccagtcttcactttgattcacatggatgtcattaataatgacctctccggagtcggctttcagcaaatctaacattaaacggaataaagttgttttcccggctccgttgttacctaccagaccaatcatttctccttgattgattgtgtagccatcgatatcgatggctgtttgggtaccgaaattttttcggaggttatgtatggtaatcatattcttttttgtttgataaatattgaatcgttatttactatctctgaatccttccatattttcgtagcggcgttgcatgaaacggacatatacattgtttatccacataggggaggtcagggtgaagcctaatccgatgattaatatgacaatgtaggcccatgtttgtcccagcagcatggggagcgtaccatagagtgtggttggtacgatgaaaagtccgaaactgattaacatctgcattccggtattcatgctttgtttgcctgtgatgctttcattgagtggtacggttttatggttgtataccgccagttggaacaagatgcaatagacaggacctgttgtcagaaagattagtgcgacagcacccagcaggctggcttttcccatcacaaaagccggtatcagcaggatcagcggaatgatttccgccaagctatagatataatatttggctgtcaacaggcttttgatagattctttgcgagtcatcagtccgtcgatatagtttccttcaaatcccataagttgtatcagaatcaccataccgaatccaaggaaggagtataccaggacaaaactcttcatgtggtcatacgtactgctgaaactcagtatgatggagaagatgattacgagcattgctaccgatcggagtgaagccttacagcgtttgttacgtaggagcattttcaactccaggcgcatgtattcgcccacctctccgtaacgttccaggaaacggtattcggatacggtttttacttttgtgtcttctactttattgatttcgttgtatattaaaccggtcatcactttacggttgatacaccatatcagaacagtggctgccaatgtacccaggtaagcaagtagatttccttcgatataaccttctcccaagttcatgaaaaagtcacttataaattccgttttgggaataaaaatagcgatggcaattccactgtagacaacgatgggaagtaacacccaccaaatatgttcgttaatcagcgtacggcaaagcagataccaatatccgttgaaaaccatcagtaaccaaatgccgatgctgtaagtgagaactcctgatattccataaaaaggaaagactgtgagtgctgcgaacggcacgaacaggaacagccagataagattgaaagagctgagcccgtggcggagaagcagaaagtcgagtatacggcttcgttttaccggaagtagcaggtaaggttttacttcttgtgtaggagttttttggaaggggaaacgtattacaaagtccagggcaagcgcaaatatcagtccactgttcaaaatatgataggcttccatattgggaacttctgtgctgatggcttttgccagaccgatgccaataaatataaagtaagcaccccagaaaataaaggaggcatacatgatgtatttgccgattttattcttttcgtacatcggatgccgtttggcagcaagtttgccgtgtcgacgcaattcgttgaatagcatagtttgttatagtttaagggaggggggagagcaaaaccaccacagattacaccggttttcattgtctgagtttcattctcggattttgaatgactgtgattctaatctgtgaaatctgtggtggaaaagattttttgatgctctttgcttttaggattgattatttattttccgcactgaccattgtcacttccacctcgttcttttgtttgaacaggtcgtctgcgaatttccgaatatcatttaccgtaatgctgttgactatcttttcgtagtcattcacacggttaacgccggtatacaggtattcgtcgatacttcccaaccagtagctattctctttcaggtcctcggtatgctttttcagcatgtactctttcaccttattcaagttggtttctgacggaccggttttcgctatgttggttatctcgtcaaagatgattttcatcaatttctcttttttatcgggggctgtatcgaagataatctgcaaaaatattttttctttgggatatttttgtaaccttccacctacgtatactccataggtacctccctcgtcttcacgtactttttctgtgtaaaccagatcaagtatctggcttgtcatgccgagcagaaggttgtttctcagatcatatttgcagtctccgctataaaacacgaataccgaagctttgggcgtttcctgtttcttggtgaattcgttcttgtaaacaccctgacgcacttctattttgttatctttaaaagtctcctgacgattgatggcagggagtgcacccagatattctgcaatgaccggtttcatcttttctacgtctacgttaccgacaaagatgaatgtgaagtcgcttgcatctttaaaacgatcctgatacatagacagaatcttattgtaatccatctgatccaccatatcggcttttatgcgtctggctctcggatgattcatataaacaccggcctgaatggagtcgttgaatgccacattcgggttcagttcctgattttttaacgtggctttactacgacttttataagatgcaaatgcatcgttgtctctgcgcggggcggtgaatgtgaggtaagtgagttgcatcatcgtttcaaaatctttgggagagcaacttcctgaaacgttttcggtcgtgagtgagatattgtaattgaccgatgctttctttccggcaagcactttctcaagatctaccgcactgaagttacctaagccaccggcgccgacagcatccagaccacttatattaatgatttccgaatcggggaataaagaactgcctcccagactgacacctttcatacggatttcgtctgctttgaaatcggtcttttttataattacctttaccccgttagatagagtcagagtagttgttccaaagatatcatctttcgtttcggaaacaatttccccccctttcggagcttcggccatcaaaggttcgtctgataccttgtctacataagcagtcagtttctccgcttttgcatctttcagcagtttgtttatggtcgcttcggaaggcagtttcagaccttctttttcaggagcgaaaagagctactacctgattattgtccgtaataagacctttcatcaattggttaattgctgccaccggaatatttggagctatctgattgataaaagtatattcgttttcaatacccggtattggttcgttatcaaggaagtgacggacatattcgtccacatatttattatttttctgtttatcccgttcgttgtaagccgactccaattggcgtaagtattctgcacgggcacggttgtattccgtttcggtaaagccgaactggcgggcacgttctatttcgcgcagcagggtggcgataccattatctatgctgtcttctttgcagaccacaactccgagaaaggcatccttggttttggatacgaaaaagttgccgtcttgcgttccggcatagatataaggcgggttagccgtttgtgccaattcatttaaacgtgcgttcagcatactgctgatcagatccttggcatactgctgtatcaggtagtccacattgcctttctgattgtcaggaattgcttcgtgcttattgaaaagaagaacctgtacatgaggttgttccttatctttcaggatacagatgatcggttctttattatcggcaaccggataatagatgcgttcggcggcattcggctgtgccggaatatcggcgaacattgttttgatcttggcttctacggcatctacgtcgatatcaccgacaatgacgattccctgtaggtccggacggtaccacttttcatagtagtctctcagtgtttgtggtttgaagttcatcactacgtccatggttccaatggggaaactgttggcatatttatcgcccggatacatcatcggtagaagtttctcttgcatacgcatcatggcactcatacgggtacgccattcctcattgatgacacctcgttctttatcaatttccttcggatcgagggtcaggtcattgctccagtcgtggaggatcagtaaacaagaatctactgctccgggggtgttgaccggtacattggagatgttgtaaaccgtttcgtcgatggaagtatatgcattcagattctcaccgaactttactccgatacgttccagatactgtttcagcgcatcacccgggaagtgagtggtcccattgaaacacatatgttccagaaagtgtgccaatccacgttggttttcttcttcttggatagagcccactttctgggcaatgtagaagtcggcacggttggcgggcagattgttcttacggatgtagtaagtcagaccattgtctaactttccgatacgtacattcttgtcaatagggatgggcggcatttgctgtgcaaaggcctgctggaagttgcagcacaggatgactgcaacgaaaagtaaaccacggaataaatgtttcattgctatactgtttttgaattctatctaccgcagcatacactgatcacactctcgtttttgatgtttttatatacaagattctgtgctttcagtgcgttctgtggtgaataatcttgtttctgttttttctatcagtcgcattgccgggaagtaaatcacataatcgcttctctaattttcaccagtttagtcaataatccttccaataggtcaagcttcagcatattggcaccgtcacttttggctactgtgggattttcgtgcgtttcaatgaaaagtccgtcgacgccgacagcgataccggctttggccaccgtctcaatcaattgcggcattcctcccgttactccatttgtctgattaggttgttgcaatgagtgggttacatccagaatgaccggataaccaaaagattgcatttccggtatacccctgtaatcaatcaccaagtcctgataaccaaatgttgttccacgttcagtcagcatcacgttcttgtttccggcttctatcactttgtcggctgcaaattgcatggcgagtggggagagaaactgtccttttttgatgttaatcgtttttccggttttagctgccgccaccagcaagtccgtctgtcggcacaagaaggccgggatttgcagaatatctacataactggccgccatggccgcttcgtcggcagcgtgaatatctgttacggtaggtattccgaaggttttgtgcactttttcgagaacctttaatgccttttcatcaccaattcccatgaatgaatccatgcgtgagcggttagctttgcgatatgaacctttgaatacataaggaattcccagtttatcggtgatgtttactattctttcggcaattcgcatggccatctcttcaccttcgataacgcatggtccggccaataggaagaagtttcccgtcttattgtttttcagttgttctatcataacatttatattttatcaattgggtataatcaatgtggttgcttccggaataattcctatttcgatgggaaaatgacgtggcaggagacgtccgtcaaggtcgactgcggcattttgtgcacgcaatacctttactttccgggtgcgataagacttcacgactttatgattcaggatacgtccctggataagcatccaaagtccggatattatttgcaggaactcaggacggtagatgactgatacatctaaccagccattataaggaacagcgcttggagtttgtccgtatccggtagcgcttcctacacagactgtcatgatccggccgcgtatatgttcgtcgttaatcttgagatgtgagcgatatagcttacgttcgaatatcaacaggaaaagagctgccaggtaggagaggaactttacgccccagaaacgtttggtttgatcggtgatttttacgatacgtgcccctaaccctatgttaacggcattcaggaaataacgtcgccggtgcttctcgccatcgtaaaaattgcagtaacctacatctattttctttcggcggttgttaatgatccagtccactgcctgcttatattccaggttcagttcccaatatttggcaaagtcgtttccaattccgttagggatgataccaatggctatttcgtcttttttttctgcattcgagctcataatgccgttgatggcgtcattcagtgcaccgtctccccccacaactacgatggttcggtaaccattgttggccaaaattccggcaagtcgttctactgaaccgaaaccttcggactgcacatagtcgtatgacactcctttagagtccatgtactctttaatttctttccatcgtttctgcacttttcgtgtgcctgctttgggattgtagattacaccccatttcccaggttctacgctcatggattttacatttattatttcgtacttctaattcaatctctctgtcagcgaaccggtttcttgcttaagcggtagatcattcgtttattaacaacggacttaccgtactttaaccgtctgacattggttatttattagcttttccctcgtcctttagctcgtcccgcatacgcgggctaatgagcccaggcaggcgggacgagttgatgaacaaagcaaaggctgttaagaacttcgccaaagttactaaaactctttgagtttctgctttacaaagttaatcttttcctccatcggaagtgaagcatttacccaatgaatggtaaagccccttcgttccattcccctaaaccaggtcatttgccgtttggcaaactgatgaatggcagtttccaagcccgtgaacatttccttatacgtcattttcccaataacatgcagagtcaggtatttgtattccaacccataataaatcaggtcatccggatggattccttgtgccaataagcggcgtacctcttctatcatgccgtcatccagcctttgcttcagccggcgggtgattttttcccgtcgtaactcccggtcgatgtccactccgataatcaggctgttcagttgtggaaactctctttcttctatcggcgtctttgcgtaatattcttcaatttcgatggcgcggattgcccgtttaacggtatctacatctgtcgagttatgaagtgtcttatactggcttaatatgccggtcagttcttccaatgatttttccgccagacgtgtgcgcaattcttgattttcggggacgggaatcaggcgatatcctttcagtaccgattccagatacagtcccgtacctccacatagaacgggaaggcgccctttttgtttaatagtctcgtaagctgtcaggaaatcacgttgatactcaaaaacattgtatttataacccgggtcggcaatatcgatcaagtgatagggaatttgctgcccgttgatggtgtaatcttccagatctttgcctgttccgaggtccattccccggtaaatctggcgtgaatcggcactgatgatttcagtatctaagtctgcagctaatgcggcagcaaaaggggttttacctgaagcggtggggccaagtatggcaatcagatcatagtccggcatggtcataactttattaatgattggacaaagatatgaaaaaggaagtgaaaatcagatgttaaactcttaaatggtgttataaaacatgctttttttcttgtattatttgcagataaccaaagagtgcgtatctttgcaatgtgtttttcatagtattagatttaaggttaacaaaggttggagcaaggcgttgctcctttttttatgtcctaatctctcttatgcgttgtgcatccatatagataacatcttctttttcaaaacaataatattgatgaatgataccagtaagaacagcaatatgccgatagtgaatgtgggccaaagtgatccggagggtatctgtgggaaaagtgagtttagtgttttgagataagatgcacgtgtccacgaaacaattcctatggataataacatcactacaatattaagtcctactgtcagggtctgataggggagtgccactttcgaagggctgtatcctatcagaagcaggctttccagcttggtggtgtttttttgcagtaacaagaaaatgctgagcatcaatatatagaaagagagcaagctgatgaatagtcccacagccagaacgatacccacaatcagtctcaggaaataagtcgttttaccggcatccagtttcccgtcttccgtttcataacctttctgctgaaaatattttgcgatagaggcgtcagccgggttgtttacttcaacaatcagtcgtgaaggatctgcctgacgatccggtgcgaagttcttgttagcccaatccatgaacgattgtggaaccagaatggtgttcaaccggttggaaaagccgacgatattccccttgtattgctctacccgtccattccccttcatcaggatgtccatctggatcagactcatcaggccttccgagagtttaggcaggtttcggctttgggcaaaaccaaagttatacaggttcagataattgcgtggaatgatgatggggagggtatgggtattttcatcgaagtaccatttgtcgaggttgacgtctacgaattcgtcaggaacggcttcgaaaaacatttccgtagaaaggtgtactcctgcttcctgcattcccagaccggcggatactttaaattgcgaaggggtgaaagcgcctactgttcgggtgaatgactgttgtttcagttcctcgatttcttcgggggagaaggtgttattcttacctgcgaaagtccctaatgtactgattttcttggtagcaataatataatctttcttcatgaaactatccccttcggtaaagatgggaagtacatctttgtagaattgtgcgctgagcaacacaatgaccatcccgaaaaggttggcaaaaaagaaaccggtcaactgaccgatgctgatatgctgacggagcagcttccagactaagttgttcataattttaatattctgtcatactttaactcgatatgctttccgatggacgtcacgatgatacccgccccttgtttctcggcttctcccgtcactaactcttccatgatatgtgcgttgtcatcgtcaagatggctgatgggttcatccaggaaaataaagtcgaagggttgacaaagtgaccggatgaacgccactctttgttgttgtccgaaagatagttttcctgcttttacattcaacttgtccgaaagtcccagtgcttcgaacaatgccaatacctctttccgggttttatatccggttaggttattctttaaccggatattttcgatggcagtcagctctgtgaaaatgcgcaaatcctgaaatagcatactcagtgaatgcttcctgagttcaacccattgcttcaccgagtatgcttttatattggtttcatcgaaattgataattccttgatagtcgtttcggtagccatagatatagctgcatagcgatgattttccggtaccggatgctgcttcaatcaagtaagattttcctttatggaaaaagaggtcttgatgccatacatccgaaatgaccgagttacggtcagcaaacacttggggaagtgtttgctgtaagtgaatgctgttcatacgctgaaggttacatgccggcaaattgtttggcaaagtctactatctgttttaaagcgttgacatctttgtttttcaggagaatggctgtttcagtcttaccttcgctgtcactgaatgcttcaatataagaaatctgtgaagcaagtttatagtaagtctggtattcttcgccaccgaaaccggttatcattttcacgacaggaagatctaaaatggcatccatgttgatgacaaagaacacatttttgcccttcatatccgatacatatccggcatctttgattgatttgtctaccggcttactgatattcttgtagaggagctcgtcattggtggcatacatttgtttgttacggatgccaaagaacacattattggtgttggacttataaacgtattcattttctcccagttggatgatgtcttcatttctacctaatttcaattctttctttttatcgtacaatgctttcaaggcatttccgttctttgcgtcagcataagcagcgaaagtgggtgcactgttcatggttacgttaatcagaccgatagagatatcaccatcgaaagatgcgaataaacttttcacctcctcggcttttgcaagggaaacgtttctgcggaattcttcgttgttgagcaataagtcatagaatgctgccccgttgactcctatgtttagaaaggcaagagtcgattccgggaaattctggaggaaagttgtatttagttttttcacagcttgagcctgcttctttagcagtgcgtctgtttcggcgttatccgaataagtttcaatctgcagagctatctttcctttctcaaagttgagattgcctacggccattacttcgcttagatcgagttgtgaagaaagtcccatactgatttgttgtgagtatatcttaggaacagcatccattgaagcaaagaagttaatgtcccctttttgattttgcatctttttgaaaccgctgttcttcatgatactgttctcttccgtctgttttaataaagtagagatggtttgtttggcaacatccatttgtgaagttccgtaggcttctgtcaagactgctgcgttttcattaaaaaccaacaggctgtttttctgcagagtagtgaagctgtatccgtcttcttctgctatcggctggcagattccctctttggccattaagtcaagagaagcacgcaagtcgtcgatattgctaaccttggcaaccatagcgggggtaatgaacgttttggaagtaaacacaaagacgggggccttgatatcgatacccgattgggaaggatccttcattatcttttccaattgctggaaggcggccgcgttcattccgcttttcagggcttccatcattttttgtttcattccttcgttttctttatcattcaggccggctttgtcggcaagcgtattcagattgacggaggcaacagccgaagcgtcagcaggaatcacatggatatattccgctttctttgagcaggctgccatgaaaacaatcagtactcccagtaccgaaagtcgggaaatcattcgttttaccataattactatatatttagttctgtaaattacatattcattgtatggcaagccactaatgccgccgtttctgttcgtagtcgtgatttgcctaaactgatcgggatgaatcccttttcgatggcttttttcacttcctcttcgctgaagtcgccctccggcccgatcaatactaatgtatcttctccttttttcagtacatccttcaggagaggtttctctccttcataacagtgggctatgaatttttgtcctgagaaatctttttcaatgaacgaattgaagtctgtcatttcgttcaaccggggcaagcgtgcctttaatgattgtttgatggccgataccaatatcttttcgatacgttccgtcttgatcacttttcgttcggaaaagcggcagttcagaaacgtcaattcatcgaaacctatttctgtcgctttttcagcgagccattcattacggtccatattcttggtcggtgccatggcaatatgcagatggccctcccataaaggctcttgatgaatagtttctttaatattcaccaggcaacgtttattggttgctgcactgatctctgcccgatagaagtttcctttaccgtcggtcagggtgatttcgtctccggctgtcagacggagcacacgcacacaatgctgtgcctcctcttccggaagctcagcattggtttgtatatcaggggtataaaatacgtgcatatcttttatttatgtcggtttatctcatcacgcagtcgggcggcaagttcataattctcttcttgaatggccttgcttaaggcttcttcaagggaaataatgctgactgcctccgtacgtgagttatcatcttcttccggtgaatcaggacgttcagcaccgtctgtcatccgaatgcattcgcgttcaaggatagattcgtatataaatatggggcaatctgccctcacggccaatgctaccgcatccgaagtacgtgcatctatccggataatctcttcgtctcttttaaagtagatatacgaataaaagacaccttcttttgctttataaatcagtacccggagcaaagatgctcccagaacattcaaacacgagtaaaataaatcgtgtgtcagcgggcgaggggcttttattcctttcaggcaaatggctgtggcttgcgcttcggctggtcctattatgataggtaactgccgttcgccatctacttctcccagtaccattgcataggcacccacctgcgcctggctgttagaaatgttcaatacctgtagttctactttcttatccattgttaattattcactttcttaagttctcccggttgatgtttgtatctgaaaacaacggcaaataaaatgccgatggccagtgcgtatgctgcaaatataaaccagatggtcggccaatctcggcttaccaacattccgttttcgtatatggagaatgcgtccactacagcaccgctggcatatcctccgatgacggctccaagtccgtttgtcataatgaagaacaagccttgtgcgctggcccttgtctcaggttttgtttccaattcaacaaataaagaaccggaaatgttgaagaagtcaaatgccataccatatactatcatggataaaatcagcatccagatgcccgtacccggatcaccgaatccaaacagcccgaatcggaatacccaggcgaacatactgatcagcatgacacgcttgattccgaagtgtctcaagaagaaggggatggccaggataaacagggtctcggacatttgtgagatagatagtagaattaccgagtgtttgacaccaaaggaatctgcaaattcgggtattttggcgaaactacccaggaatgcatcaccataggtgtttgtaatttgcaatgccgcacccaatagcatagagaaaaagaagaaaatagccatcttttttcttttgaacaggctgagggcatcaagtccgaaagaagacaataaagttttattttcattcttcgccggtggacagggaggcagcgtgaaagaatatatccccaaaagtaaggctgaacttgctcctacataaagttgtgcactggagttcttgaatcctgtaaggtctactgcccacatggcacagatgaaaccgatggttccccatacgcggataggcgggaaatcctttactaaatcacatttatattgttcaagtgcgttatatgaaactgtattggcaagggaaagggtaggcatgtaaaccatcaggttgagtaacatggcccaatacatttgattatagtcggtagcggtggatgcgtaaaacaaacagccggctcctaataaatgacaaataccataaagacgttcggcgttgaaccatttatcggcaataataccggttattcccggcatgatgatagatgcgattcccattgtagcgaagatagctccgatttgtccaccttcgaaatggaggcctctttccatatagccacctaatgaaattaaccacgacccccatacaaagaattgcaggaagttcataataatcaaacgattttttatattcataactttattgatgtgtttcccgtcgtgccaatatatggcagatcagctgcaaatataatatttttagttgacagagtggaaaaagcacaggataaaagggaggaagaaagggaaaaatagcaaaagaaaattggaaatgcaaagaaggaaagggtatataaaaaaagaaggctatctatcccagacagccaatctttattaaccttaaatctaataccatgaaaaacacattgcaaagataaagggttttatgttatagaacataatgatttggtgaaaatcttctgtttgttaactcatattaactttgtagcttctgcttttatgctattaaggcgattattcgacatacagtaccaatcctttgagatattcgccttccgggtgatagatatttaccggatgatctgctggttgagtcaactgatgcagtatgcgtacacttctaccggacatggctgctgctgtgaatacagcagtacggaaattatctttggtcaccacctgtgaacaagagaaggtgaacaggataccgcccggtttgattttctcaaatgctttggcattaagtttgcgataaccttggagggcgttgcgcaatgcgtctttgtgcttggcgaatgccggcggatcgaggatgatcaaatcgtattggtcgcccatgcggtcgagatatttgaaagcatcttctgcaaaagccgcatgacgggtatcacccgggaaatttaattctacatttttattagtcaaatcaatggccttggcagaactgtctaccgaatgtacctgtttggcacctccacgcatggcgtaaaaggagaatccgccggtgtagcagaacatgtttaataccgaacggtctttggcataacgttccaacaaagcacggttttcgcgttggtctacgaagaatcccgttttttgtcctttcagccagtctacatggaactttaatccatattcctgagcgatgttgtcgttacttcctcctttgaggaaaccgttttccggaaaaaggtccgctttgaatggcaaagtcgtttccgatttatagtagatgttttcaatctggttgcccattacttcggacaatgcttcggcaatggccatgcggtctacgtgcatgccggcagagtgtgcctgcattacggcggtccgggcataaacatcgataacaagtcctggcaggttatcgccttctccgtgtaccaggcggtaagtgttgttagtcgggttggtagcgatgccgatgctgcgtcgcatgtcataagccacttccaacttgcgtttccagaagtcatggtcgatctcttcttgtttaaaggaaagaacacgtatggcaatgcttccgatttggaaatgccctttagctatgaattctttttttgaggtatacacttccactacttctccttcttcgggttcgccgtcgaagtgagcaatggccccggagaaaatccagggatggaaccgtttcagtgagtcttctttgccgggtttaagatatactttatgcataaatttattatgttgtttttatttttatcattgatccgaacctgctttcaccgtctctacggtttcttcttccggggccagttcgtaattacccgtacgctttaggtcttgcagtaggtggtatatgttgaggcaagcccatgcgtctgtagctgcatattgcttttgggcatccgtcagtacatctgcttcccaattggaaagacgttgtgattttgagattttttccctgaataagataccgtatatcttttgcaggcttttatcctgaatgccgaacggacggacatactcttgcaactcgatgcatgcctgctggttgaaaggagcccgtttatgcaacatcataaagtcgtctttcaacgagagtcctactttgatcacttccggattttcaagcaactctatgatgggttgggtcagcccggtcatgttcaggcggaacaggaagcaacattcgtcagatgaaatctggagcaatgctactttatgggaatgtcctttggtgaatgagggacgggtttcgctgtcgatgcccagaattgcctgggattgcagataagccactgctttttccgcttcactttcagtttgtattacatgaatccgtccggggaatgccgctttgggcatctccttcacctcttctttgcttatggttctttttaaaatcatattcgtttattcatcgtcgtggcaatgacagccatgatcgtgacaatggcagtcgtcatcttcacagtgacagtcttcattgttttcgggttcgtattcatcctcctcttcgtcttctccccgggccttcggactatatttcacgtcatgcagggcacgcatggtatttaccagtttttgtccccacaagagtccgaagttttcctggcaaatggcaagggagtcattcatcgtctcgttcaatcccagttgaaatacaaagataaaatctttaatatcctgatagatatcggccaggtcttccgaaatattctttttgatgggttcatcgctgtaagccatgtcgggtaggaatacttccagatagtcgtccttttccgccaatacggatgccaggttgatgcgcaacacttcgtatatttcttccgtcacatatgtttccggtgcttcgtcgcctatcatttcgcattttggaagcatggacgcttttagataaagtaaaggaagaattttcagggtggtgtcaacaaacatactacgtttcatgccttcggcacgttccagaaaagcgcagaactcagcagctaccgtaacgaattctatcacattcttatcaaatattacttggctttcttttttcatatcagcttgaattgaaacgcaaaggtaagaaaaagttgtgggtagtccaatgaaattcttttttttactacttttgcatcattaatcatatagcttaagattcttcatccacatggcaaaaaagaaatcagataaggaagcagaacagaagccggcttccacaaataagtacttggctttcttcagaaacgaaacaatccactttgtgatcggattggtattggtcatcttttcagtctatctgttgctggcttttacctccttctttttcaccggagcagccgaccagagtatcattgatagcgggaatgcccaggatcttgctgctgtaaataatcatgtaaaaaactatgcaggttcccggggagctcagctggcaagttatctgatcaatgactgttttggtgtctcctctttctttattttggtttatctggctgtagccggattgaagctgatgcgtgtgcgtgtggtgcgtctttggaagtggttcatcggatgtacgctgttgctcatttggttttccgttttcctgggctttatttttatggatcattatcaggattcattcatttatctgggtggattgcatggatataatatcagtaactggcttatttcgcaggtcggtattcccggtgtttggcttattcttttggtgacaggcatttgttttcttatatatatgagtgcccgcacagtcatctggttgcgtaagcttttcactcttagtttcctgaaacgcaaacaaaaagaagaacattcagaggtgaagcaggattccgatccccgtgaatatgataatccgaaacctcaggaagtggaattcgatgttaatcgcactttccgtcaggaggtaccggtgaagaaggtggaaactcctaccgtatccgatctgcttgtcgagtctccttctgagtctccaatagttacggaaagcagaaatacggcaaccgatggtgatgtcaccatgactttcgaacagacaactcctgatcctgtgcccccttttcgggcagagtcggcagataacgggcctgagtttgaaatagaggctgctgccgatgacgaaagttatcagggaacggaaaccgaaccctataatccaaagttggatctggaaaactatcatttccctactatcgatttgatgaagcactatgaaaatagtgagcctaccatcaatatggaggaacagaacgcaaataaagaccgtatcattaatacattgcgtagttttggtattgaaatcagtacgattaaagctacggtaggtcctacggtgactctttacgaaatcactccggaacagggagtgcgcatctcaaagattcgtgggttggaagatgatatcgctttaagcctttctgccttgggtatccgtattatagctcctataccgggaaaaggtacaatcggtatcgaggtacctaattcaaatcctaagattgtttcggggcagtccatcatcggcagtaagaagtttcaggaatcgacatacgatttgcccattgcgcttggtaagaccattacgaacgaggtattcatggtagatctttgcaaaatgcctcatgtgctggtggcaggtgctaccggacagggtaaatctgtcggtttgaatgccatcatcacttcattgctctacaagaagcatcctgccgaactgaagttcgttctggtggatcctaaaaaggtagagttcagtatttattctgttattgagcatcattttctcgcgaagcttcccgatggtgaggatgctatcatcaccgatgtgaccaaggtggtgcagaccctcaactcagtctgtgtagagatggacagtcgttacgatctgttgaaaatggcacatgtacgcaatatcaaagagtacaatgagaaattcatcaaccgccgcctgaatccggagaaagggcataaatttatgccttatattgtggtagtcatcgatgagttcggagacttgatcatgactgccggcaaggagatcgagttgccgattgcccgtattgcgcagttggcacgtgccgtaggtatccacatgattattgcaacccagcgtccgactacaaatatcattaccggtactatcaaagccaacttcccggcgcgtattgcgttccgtgtgtcggccatgatggactcacgtaccatccttgaccgtccgggagccaatcaactgattgggcgtggtgatatgcttttcttgcaaggggctgatccggtgcgtgtgcagtgtgcttttatcgatacgccggaagtggaagaaattaccaaatatatttcacgccaacaaggatatcctaccgctttcttcctgcccgaatatgtgagcgaagacagcggaagcgatctgggagatgtcgatatggggcgcctcgatcctttgtttgaagatgctgcccgcctgatcgtaattcatcagcaagggtcaacttcgttgatacagcgtaaattctccattggctataaccgtgccggacgcttgatggatcagcttgaaaaggccggcattgtgggtccttcgcaaggaagcaaggcgcgcgacgtactttgtgttgacgagaacgaccttgaaatgcgtttgaacaatattcaataatcaaacgttaaatgagtgtatacaatgaagcagattataattagcatttggatagctttactgactttgcctgtgtttgcgcaacaacaaatgcaggcaaaggttgtgcttgataaaacggcagccacatttgagaaagcaggggggattcgtgcgggattcaacgtgacggtgttcaataaaggccggatggcgggacaatctgccggagtcattgaactcaagggagagaagttcgtgctgaaaacggacgatggtaccacgtggtttgatggcaagacccaatggagttatctggcaggtagtgacgaggtcaatatcagcaatccaaccggagtcgaactgcaaagtcttaatccgtacgcacttttgcagatttatcgccatggtttcagctataagcttggaacactgaagaattttggcggcaaatcgatttatgaagtggtgctgactgctaccgacaagaaacgggatttatcacgaattgtgctttatgtcagtaaagacacttaccagccactcttcattctgatggaacaacgtgataagagccgtagcgaaatcacggtgaccagctatcagacaggattgaaatatgccgacagtatgtttgtgtttgataagaagctctatcctcatgccgaggtgatcgatctccgataggtcaagaggagtaacttcgatcgtttattataaatcgtagaatgtaaaaaaggaatatggaaacagaaagaattaaatgccttattataggttcaggaccagccggctacacagccgctatttatgcaggacgtgcaaatttgtcaccggtgctttacgaaggaatacaaccgggtggacagttgaccacgactaccgatgtagaaaatttcccgggctatcctcagggaatcagcggaccgcaattgatggaagatcttcgtacacaggccgaacgattcggtgctgatatccgttttggaatcgctactgcttccgaccttggccaagctccttacaaaatcacgattgatggtgaaaaagtaattgaagccgattcattgattatcgctaccggtgccacagccaaatacttaggtttggatgatgaaaagagatatgccggtatgggggtcagtgcttgtgctacttgtgacggatttttctatcgcaaaaaggtagttgctgttgtgggtggtggcgatactgcttgcgaagaagccatctatctggccggactcgcttctaaagtctatttggttgtacgcaaaccctatcttcgtgcttcaaagatcatgcaagagcgtgtgatgaagcacgataagattgaagtccttttcgagcataatgtagtcggactctttggagataacggtgtagaaggtatgaatctcgtaaaacgttgggaagaaccggacgaagaacgttattcgttgcctatcgacggatttttccttgccatcggtcataagcctaattcggacattttcaaaccttacctggatactgatgaggtgggatatatcatcactgacggtgatagtccccgtaccaaggttcccggagtgtttgcggctggcgatgtagccgattcacactatcgccaggctattactgctgcaggaagcggctgtaaggctgccattgaggctgagcgttatctgtcggagaagggattgatctgatagtcgtaagatattgtttattaatataccggacgcaaccatgcttaataagagagagctggttgcgtccggtagtttttttataacttcttatttctttattgattttgcgagatcaagcccctatggcaccctacaaattcgtcttgttcaattctatatgttgtatcagagtcatctcaggcttgattctgttttatatttatcacttatccggatagatgaagttctttttccggtagttttcatttcaccaccgattaacagattacattgagaagaagataattgggattatttatttttatgtaatcgtcaatcgatggaaaaacaaattagtatacttcaatttcgtccagatacaggtttgcctgaaccacctctttgctgcccgggtcttttacgaagtcgatgccgtttcgcaaagtaccgccattctgaagggtgactttgagataggttacttctctcggttcgaaggctaaggtgtctgtaaatgcctttctgcctctttccggatagttgcgtttgaaggaagcttctgcgactttgctgtatttttgtccgtcggaagaggtttcgatggtggcaacactcggagggaggataactgacgcagggttgtatagagaaccgaagactactttgctgacagtagtgggctcatcgaattcgacgatgaataccatctctttgcagttatcatccatccggaatccgctccacggagtcatagaggcggtgttgccgcgtttaccgttggtaagcccgaaggtacttatgtccgtgccgagaacgtcattttcaccaaagatgtcgcctttggcacctccaatggccggagtgactgtgaagctctttccgctgatcaggttgccgtacagtttctttccggtgaccttgcccagcatctgtccgtctttgaaagcggctgctttcacttcaatttcgcccgagagggtgaaagggcgattgtagagggccgattctacggttggagtacttccatctgttgtataatgaatttccgcattgggataaaagctttccagtatcacttttagcgtatcactctcgtctacatgagtatttatgttcacatcgaagaaattacggcaggcttttacattcttcacgtccattcgccggaaatcttcaaccatgcgctggcagaagtcattccagtttttgtttgcgttcagtgtccaaccggtttcggcaatagctattgcgcgcgggaaggcttgatagtcgcggttattgtcgctcggcatgtattcggtccaaatgttgccttgtactccgatgatgtgtttttttaccaggtcgtctgcatcgtccggtaccgggttataactgtaggtttttttaagtgtattatatccgccgatagtaacgggggctatctccggttcttcctgatattgatccagataagcgtatggattcggagtcataatagcgttgtgaccggctttggctgcattcattccgccttctactccccgccaggacatgacggtagcattcggggccaacccgccctccaggatttcgtcccacccgatgatgttgcgtcctttgctgttcaggtatttctccatgcgggtaatgaagtaactctgtaatttctcctctttggtatgcttcttcccgtcaataacgttgggagtgacatcgtctttcagtcccagttgtttaatcagtgactggcaatattcacttttgatccaggccgttttcggacattcgtcaccgcctatgtggatatatttgcttgggaagagatccattacttcgtccatcactccttcaaggaactcgaaagtggtatccgaaggacagaatacctcttcgaatacgccccaggttcccgtcacatcgcatgtactgtccggtgtacacgaaagctccggataagaagcgatggcagctattgcatgtcccggcatttcgatctcagggattacagtgatgaatttactggcagcatagtctacaatgtccttgatctgttcctgtgtataatatccgccatgctctttgccgtcgaatatttgcggatagttcacataataatagtctatcagtgtctctttgcgcttggagcctatctcggtcagtttcgggtatttcttgatttcaattctccatccctgatcatcggtcaggtgccagtggaaggtattcattttatgcatggccagcatgtcaatgaacttatatacatattccactggagagaagtggcggcatacgtccagcatcataccgcggtatgcaaagcgcggggcgtcttctatctcgacagccggcactgaccattctgcgttttttactttctctgtgccatatacggcgggaggaagcaattggtaaagggtctgtaatgcatagaaaaatcccttgggggtggaggcgctgagagtgatattctgcggtgtgaccgagagtttatatccttcttcgggcattccgtcctgggggacaaagcggatgacgggctcgtccgttatgttttcgaaagtctgtttcattgtgattccggacgtcaacttcaatcggttgataaggctgtcggcaatggtctgtacttccggtgtgcaagcagtagtgatgactcttacttttttacttatttcaaatcgcccctgttggggaatcatttggttgggcaacggaacgatattgtactcgttcacgatggcttcttttgactgtttacatccgggggcgatgaaaagtagagacaaaagaagaagagtaattccttttttcatggtctgataaatatgtgttaagttattaaatagtgacgaagcgtcttaaccgattttgctgatcttcttaagcttttcttcgtcaatgatcttgatttttcttccgtcgatggtgatcaggcgttcggttgcgaagttggacaacgtgcgtatggcattggaagttgtcatattcgacaggttggccaggtcttcacgggacagatagatgctcagggtagagccgtcttcctccagtccgtaactctctttaaggaagagtagcgattcggccaggcgtccgcggatatgtttctgggtcaggttcacagttctttcgtcggcgataccgaggtcaacagacaactggcgaatgaaaaacatggccaggtcgttgttctggccgagcagtgtcatgatggcactcatgggaatcaggcagatagttgaaggttcgaatgcggaagcggcggtcacatagtcttctttggcaaaataagcccggtaaccgaaatattccgtaggttttatcatgcggataatctgacttctgcctcctacaccgtctttgtagattttaacttttccgctaaggagacacatcagataggcaggcgattcgccttcgcaatagattgtttcgttctttttgtaattctgaagagtgaaattattggccaggaactctctctgctctgcgtttagaggagcccacatctctgcaatacgttcgggaacgtttatttctgacaaattcatctttaccatgactgctgcaaaactgtgttataaagcacaaatgtagaaagaaaaaatgaaaaacggaatagttttgggaaaagtttgccatgttggcattgcaataccgcagattccacagatgtatgcagggtttatttctttcattacagaagtagagagggcacagtgaaactatatttttgaagatatattcataaatgattaaaagcctgtgaactctgtatcttttgtattgcattctttggctgttccttgtataccttttgatctctatatctaaaacatccgggtgtttatgaagataacatccccatgttgttgtgtaaaacatccggatgttttatggtaaaacatggggatgttttaaggtgaaggaattagtgcttgtagtggaacatttataaataaaaaaagaaagtgtgtcgaaactcaccacagagtaacacagagtgaattttaagtcattgattatcagtattgataatctgtgataatctgtgtaacctgtggtgaaaagacttttgacagagtcctattctataaagtatagggcttactttgtgaatagtagttctctatacttcggtaacggccagatttcgtcgtcgatttccatttccaggtggtcaatatgatcgcgtatgctttccagatagggacgtacggtctcttcgtaggcaaatgctttttccttaaagttctctttatggtttgccactttgcgggcctctgtcatgtcgcgtaccagtaccttgatggcagacacacggtgcgagatttctttgataagctctttccggtcggcactcatgatttcgtattcttctgctgggaagatctctttcattctgcaaaggttttccagcaagcggttctgatagctgacagcaatggggacaatgtggttgatggccaagtcacccaatacacgactttcgatctgtactttcatggtgtacttttcaagttccacttccaggcggcaggcaagttcggtttcgttaaagatgcgttcaccgatcagtacggctctcgattggttgtccatgtagtgcatcagggcttccggtacgtggcagatgtttgtcagtccgcgacgagcagcttcctgcttccactcttccgaataaccgtccccttcgaaacggatgggttcggaggcgatgatattttccttcaggatgcggaagatggcttcatccttgctaatgccttcttccatcagtttgtctaccgatgctttaaattcgttcaactggttggccatggcagcgttgatggcaatcatggcagcggcacagttggccgatgaacctgcggcacggaactcaaagcggtttccggtgaatgcgaatggagaggtgcggttacggtcggtagtatcgagcaagatttcggggatacgtccgatgcccagtttcagggtagtcttctcttccggagtcattttggaattggtcacctggcggacaatttcgtccagagtagccgacagttgcgaacccaggaagatggataagatggctggaggggcttcattggctcccaaacggtgactgtttccggcgctcatgatcgaagcacgcaacaggtcctgatttttgtgaaccatcatcagcacgttgaccagaaaggtgaggaacaacatgtttccttttgggttcttgcccggtgcaaagagattgacacctgtgtcagtacaaagcgaccagttgttatgtttacccgaaccattgacaccgctgtatggcttttcgtggaagagtacggcgaaatgatgcttgcgtgcgatgcgcttcatcagatccatcaccagctggttatggtcatttgccaggttgcagttttcgaaaatgggggccaactcaaactggttgggagctacttcgttgtgacgggttttcaccggtatgcccagtttgtggcattctatttcaagctctttcataaaggctgtgacacgtggagggatggagccgaagtaatgatcttccaattgctgatccttagccgaagagtgtcccatcagggtacgtccggtcagtcggaggtcaggacgcgcattatataaagaggtgtcgaccaggaaatattcctgctcccaacccagattggtaaatacgcgggttacgtttttgtcgaaaagctggcacacttcggtggcagctttgtcaacggcggccaatgctttcagtaacggagttttgtagtcgagcgcttcgcccgtataggagataaagattgtcgggatacaaagagtggtgtctaccacaaaagccggtgaggatacatcccatgctgtatatccgcgggcttcgaatgtatttcggattccgccgttggggaaggaagaagcatccggttcttgctggatcagtaattttccggagaagcgttcgatgacttcaccgtcttcgccaaactcgataaagccatcgtgcttttcggcagttccgtccgtcagtggctgaaaccagtgtgtatagtgtgtcacgttgagcgatttagcccagcttttcataccattggctatcagatcggccatctcacggctgatgggtgtacctttttcggtagcgtctaccactgctttgtatgcttccttgggaagatattcctgcatcttcttgcggtcgaatacgtggctggcataataatcggatagtttgtttgagggagtggtaacttctaagggctttctgttagatagctcttgtaatgcgaaaaatctcatttttgacataatggtgccttttttatcggttgttgggcgcaaaattatgtgttttttctgagataacccctatttttataggggtattttctataattagtctcttttttaagatgacaccctgttttaagaaggtagatcggattcgtataaatcattaatttattagtcgtataatcggattttttttatatttgccttgaataaaggagattactatttgagatacaagatatggatatgggtgtttgggcttgtcttgctctctttttcacaaaagggagtggctaacgttgttcttgatcctcagaccaaacgtccgatttctgccgattccattttaaataatgtgatgacctttgccccgttttatgaaaagttggtgaccgactaccgagccgacctctatataaaaggtacgatggacatcaaacgcaaaaattttattctccggtatgtgccttccatgttccgtcttcagaaaggagtgcgccagtatatggtggaaacatatagtgacctgcattttacggctcctaatatttatgaccaaaaagtgaaagcctctgtaggtacggtacacaatagccggggagtgccgggtatgctggagtatttcaatatcaacctctattcgtctacgctgctttatgatcggttgctttcgcccttggccaaaaatggacggaagtattataagtatctgattgattccattatgggggggacagataaccggcagtataagatacggtttatccccaaaagcaaaagcgaccagttggtgggcgggtatatgattgtgagcagtgatgtatggagtgtccgcgagatacgattttccggcaggtcggagcttttgctgttcagttgtctgataaagatgggaggagttggagaagatgatgaatttctgcctgtcagctacaatgtcgagggacagtttaatttcttgggtaatcgtatcaacggggtttatgtggcatcactcaactaccatgacatcgtacttgaagaaaaccagaatgaatggaaagaaaaagtgagggcaaggacaaaaggaaaaagtaaatatgatctttcagactcttacaacctgcaatgtgagactgcttcttatcatacggatagtgcctactttgaaacattacggcctattcccttgtcggaaagtgagcgtaaattgtacgaggaagatgcgctgcgtaaagacaccattcagcgcaatatcaagccaaagagtaagagccaggtgttctggggacaggtaggagatgtgctgatcagtgattataaattgaatctgtccaatttgggaagtgtgaagtgctcgcccataatcaatcctttcttattgagttacagtggaagtaacgggctttcttacaggcaatcgtttaagtacaaccggctttttaagcacgaccggctgttgcgtgtggtgcctaagttgggttacaactttacgcgcaaggagttttattggtctgtcaattccgaatttaattatctacccgagaaaatggggaccttccacgtggactttggtaacggaaaccggatttacagcagtgatgtgctcgatgacctgaaggccataccggatagtgtattcgatttcaaccagattcatctggattatttctatgacttatactttaacttcaggcacagtatcgaaattattaatggactggaattgagtgtgggcttttccacccatagacgaaaagccgtgaaaccctccaagttggttccattgaccaagagcctggaacttcccaacgaagatattcagggaaaaatcaggaatacctatttaagctttgctccccgggtccggttggagtggaccccttgcctttactattatatgaacggccatcgtaagatcaacctgcgttctaaataccccactttttcaatagactgggagaggggtatcaagggggtgtttggcagcaccgggcaatatgaacgtctggagtttgacctgcaacaccatatccctttgggactgatgcgtaatatctattatcgttttggtttcggtatgtttactaaccagaaagaaatgtattttgttgactttaataatttcacccgtagcaatcttcctgaaggttggaatgatgaaattggcggagtatttcagcttcttgaccgacgttggtacaatgcttcacgcaagtacatacgggggcatttcacctatgaagctccttttttacttctaaagcatctgatcaagtatacacgctatgtgcaaaacgaacggttgtatgcaagtatattatcggtaccccatcttcagccttatattgagctgggatatggaatcggcactcacattttcgatttcggcgttttcgtaggaagtgagaactggaggtataccgaggttggctgtaaatttacgtttgagttattcaaccgctaattttattcttgttattatttgtcggggaggagaaaacctttatctttgcccgtaagaggatgagataaagatttagcaaaaaagaggtgcagtcgcctcgtgaattcagggtctttctggatttctttattaagatactcataataaagaaaagtaaacactctcatcctcttttttacttgcttctatatattaattaaggtataaggatggaactacttttagctattgtgattgtcgttaccggttggctggtttttagtatcattcgttcaagtaaaggccaggaaggatataaaagatggaaagccggaaactatgccggtgagaatccttatgctaaagagaagaaggaaagtgtttcgtccctgaagaatatttttggtaggaaagccgtggctttcggctcaaagcggttcgatgccggagctgtcagttggtgtgccagtttacttggagtcaaagaagacacgttgagagaggtgctggattatgttccgaggcaatacacccagttctatataaagaagagaagcggaggagtccggatcattacagctccccaaggtcagttgcgagctatgcagcagaccatttaccaacgagttttattgttagccaatgtgcatcctgctgttaccggattctgtcctggtaaatctgtatccgataatgcgcgggttcatttgggacgaaaaaatgtattgaaagtagatcttcatgactttttcccttccatacgttcgcccaaagtgagagcgacattcagggagatgggatattcacgtcctatagcgaaagtactggcggaactctgctgttgtaacaggtgccttccgcagggtgcgcctacaagtccggctctcagcaatattattgcttatccgatggataaaaaaatgatggcgttagccgatgaatacgggctggtctatacgaggtatgccgatgacctgaccttttcgggagattttctgccgaaggataaagtcttgtcacggattgatcaggttatcagggaggaagggtttacgatgaatgtgaagaaaacccgttttctgcctgagcataaacgtaagataattaccggagtatcagttagttcgggcacgaagatgacaattcccaaaactaaaaagagggagatccgtaagaatgtgcattacgtcctgacaaaaggattggccagtcatcaggagcatattggctccaccgatccggtttatctgaagcgtttattgggcaatctgtgttactggcgttccatagaaccggataaccgatatgtatccgattctatcgcggctttaaagagcttgatgtgagacataccgattgtagctctttttgatattttttttgctattcttttctaattcaagaaaatagttctatctttgcgcccgatttatataatcaatataatgtcttatttaattaaagaattactaaacaattaattattaatggaaaacttaaagaacgttgctcctattgaagacttcaactgggatgcgtatgaaaacggcgagagcttcgctggtgccagccacgaagaacttgaaaaagcttacgacggtacgcttaacaaagtaaatgaccgtgaggttgttgacggaactgtaatcgcaatgaacaaacgtgaagttgttgtgaacatcggttacaaatcagacggtatcattcctttgaatgaattccgctacaatcctgatctgaaagtaggtgacactgtagaagtatacatcgaaaaccaggaagacaaaaaaggacagttggttctgtctcacagaaaagcccgcgctacccgttcttgggatcgcgttaatgctgctctggaaaatgaagaaattatcaagggttacatcaagtgccgcactaagggtggtatgattgttgacgtattcggtatcgaagcattcttgccgggttctcagatcgacgtgaaaccgatccgcgactacgatgtattcgttggcaaaacaatggaattcaaagttgttaaaatcaaccaggaattcaaaaacgtggttgtttctcacaaagctcttatcgaagctgaactggaacaacagaagaaagaaattatcggtaaacttgaaaaaggacaagttcttgaaggaaccgttaagaatatcacatcttatggtgtatttattgacctcggtggcgtagacggattgatccacatcactgacctgtcttggggccgcgtaagcgatccgaaggaagtggttgagctggatcagaagttgaacgtagttatcctcgactttgatgacgagaagaaacgtatcgctttgggtctgaaacaactgactccgcacccatgggatgctttggatccgaacctccaggtaggtgacaaagtgaaaggtaaagtagtggttatggctgactacggtgcatttatcgaaatcgctccgggtgttgaaggtctgatccacgtatcagaaatgtcatggtcacagcacctgcgttctgcacaggacttcatgaaagtcggtgacgaagtagaagctgtagttctgactctggatcgtgaagaacgtaagatgtctttgggtatcaaacaactgaaacaagatccttgggaaactatcgaagaaaaatatcctgtaggttctaaacatactgctaaggttcgtaacttcactaacttcggtgtattcgtagaaatcgaagaaggtgttgacggattgatccacatctctgacctgtcttggactaagaaggttaaacacccgtcagaatttactcagattggtgctgacattgaagttcaggtactggaaatcgataaagaaaaccgtcgtctgagccttggtcacaaacaacttgaggaaaatccttgggatgtatttgaaacagtatttactgtaggttctgtacatgaaggtacaatcatcgaaatgttggataagggtgctgtagttgctcttccttacggcgttgaaggtttcgctactccgaaacacctcgttaaagaagacggttcacaggctcagatggacgagaaactggaattcaaagtaatcgagttcaacaaagacgctaagagaatcatcctgtctcatagccgcatttttgaagatgttgccaaggcagaagaaagagctgagaagaaagctgcttctaacgcaaagaaatcttctaagagagaagaaactcctgctatccaaaatcaggctgcttctactactttgggtgatatcgatgctttggctgctttgaaagaacagctggaaggtaagaagtaattcaaatctttcatagattgatatagaagggtatctcattcaatgggatacccttcatttttttgtatgttgaatcattgcgctgaactttaattgtctatctttgcaaatacagtttgaaagatggaaaaatttgaattacatatattgggttgtgggtccgcattgcctactacccggcattttgccacttcgcaggtagtcaacttgcgtgataaactttttatgatcgattgcggagaaggggcacagatgcaattgcgtaagtcgcggttgaaattttcgcggctgaaccatatcttcatttcgcatctgcatggtgatcattgcttcggattgatggggcttatttccactttcgggttattggggcgcacggcagagttacatatccattctccaaaaggattggaggagttattggctcctatgcttaatttcttttgccatacgttggcatataaagtcattttccatgaatttgacaccagacaagcgtcggtgatttatgaagaccgttcgatgacagtcaccaccatcccgctccagcaccgtattccctgttgtggctttttgtttgcggaaaaggcccggccgaaccatattatccgtgatatgatcgatttctataaagtaccggtctatgaactgaatcggataaagaacggtgcagactacataactccggaaggagaagtgattgctaatgtgcgcttgacccgcccctcggatcctcccagacggtatgcctattgctcggatacgattttccggcgggagattgcggaacagatctcaggtgttgacttgctttttcatgaggctacatttgccgaatcggaactggcacgtgctaaagaaacgtaccatactacagccgcccaagccggccggatagctgtggaagccggtgtacggcgattagtgatcggtcatttctctgcccgctacgaagatgaaaatgttttgctgaaagaagcttcggctatctttccggatactatacttgcaaaagaaaacttgtgtataagtctttaatttcgggagaccgattaaacctttgttgaatagaattgtctaaaataacatatacgaattacaaacgaacctatgaacccttataatgaacgagaggttttggcactccttcaggatgagaggacacagaagcagggatttgagcagatcgtttcgcagtatagcgaacaattatactggcagatcaggcggatggtactttcacatgacgatgccaatgaccttcttcaaaatactttcattaaggcatggataaacattgactatttccgggctgaggcaaagctgtctacctggctttaccgtattgccctgaacgaatgtatcactttcctgaataaacaacgggctatgaatacaattgccattgacgatccggaggccgacgtgactcagaaactggagagcgatccttacttctcgggggatcgggcagagttattgcttcagaaggcattgctgacccttcctgaaaagcaacggatggtgttcaacctgaaatattatcaggaaatgaaatatgaagagatgtcggagatattcggcacttcggtgggggctctgaaagcttcttatcaccatgccgtgaaaaaaatcgagaagtttttggaggaggctgattaaaccttttaatatgcataatgtctaagaagaagagaggagaagaacgtatgaaagaagaagataacatattgaagaaagtggggagggagaattcctttaaagtacctgagggatactttgaaaacttgacttcagaggtgatgggtaaacttccggaaaaagagaagcctgcttttgaagaagtgaagcaacccacaatgtggaccagggtgaaacctttattctatatggcggctatgtttataggagctgcattgattatccgtgtggcttcttcaaatcaccagccggcaacggtggatgatcaactgactgcaaatgatgcaggaaccgaagttgttttggatgaatatattgatgtagcactggatcgctcgatgctggacgattactctttgtacgtctatctcagtgatgctacagctgaataagtaaactaaactgatttaataaagcaaaatgaagaaactgattattctattgattatagtttgtagttgtatcccggcactgaatgccatgggagatcctaaccaacatttgtcacccgaagaattcagggccaaacaacgagcatttataacagaaaaagccggtctgactaaggaagaggcagcaaagttcttcccggtttactttgaattacaggaccggaaaaaacaactgaatgacgaggcctggaagttgcttcgtagtggtaaagatgataaaaccactgacgcacaatatggagaaatattggaaggggtatacgatgcccgtattgcttcagaccgtctggataaaacttattttgagaagtttaaaaagatacttccgtgtaagaaaatttatctgatacagcgagcagaaatgcgttttcaccgagagttgttgaaaggggttcgtgataacaaaggaaagaaaaaatagaatgaaaaattgctctcctgcaagagcgggagaatttaccacagacttaacggattgcacagataaacactaattggggatatttattgatccgtcaattacatactctgcgcaatccgttagtttgcagtggaattttggtattatccttttagaggagagaggaccttttacagtcctttctttttggcttcatcccagattgcatccatttctgcgagagacatctctttcaggtttttgccttccttaatggtgtgttcttccagatagttgaatcggcggatgaatttttggtttgtacgttctaaggcattgtccgggttgatcttgtagagacgggcagcgttgatgaggctgaacatgacatcaccgaattcggcttccgccttatctttgtccatatgggctatttctacctgaaattctgcaatttcttctttgactttttcccagacttgctctttttcttcccaatcgaatcctacattacgtgctttgtcctgcatccggtaagctttgataagtgagggcagggcagtagggactccgcttaatacagttttatttccgtccttttcctttagtttcagctgttcccagttttcggatacttgtccggctgtgtcggcttttacttctccgaaaacatgtggatggcggaaaatcagtttttcgcagagtttgtcacaaacatctttcatgtcgaaatcaccggtttctgagcctatttttgcataaaaggccacgtgcagcaatacatctcccaactctttacaaatatcttttttgtcatcgcgcatcaatgcgtcgcacaattcgtaagtctcttcgatagtattggggcgcagactttcgttggtctgtttgcgatcccagggacattttacccgaagttcgtcgagtatatccaggaagcgcccgaaggcttccatctgttcttctcttgtatgcatgtttattctttatttgattcttttttccattcgttgtatgaaatcagcagaccgatgacttccgaatagtttttccgtccgctttctattttgtttcctttcagatataagtcatatatccaatcttgaatatcacctatcaacgggctatatttagccatccaatactcttgatccttccgggcgagttcgatgatttccggacgtatccgactgaataattcccggtattcattttctgtcatcaatctgcgggcattagcaagcacatgtcccaggatagagaagtaaccgctaaagcggatttctctatttgtagaacgtgtgcagacctgataggcgtaaaagttggcttccgcttcactggtgatacccaataagtgggccagttcatgcgtataggttgctggatattgtggaggtaacaagtcaccattcagcgtgaactcacagaaaaacggtcccatgcttcctgttactcctaccattgaaataagtggagtgaacaacattgttttgacctgtggcatggagtgtggaggatggtgtacgccgagactgtcactgatcagactgtactggctgactgcctctttacagatggtttccttgtcgatccgggttatgggaacgtatgattcattcagtaaatagatgtattggtttacaaagtggtcaaaattttccggagtataggtaatatatggtatccctgtacgctcgtagaagtttctttgcgaatagttgagtccccatgccaggtaaaaccatacatagatccatgccagatattccatatcccttctcaggattgttttccagcttaacttttggcggatgcgtgcgtataccggataaagaataatccctgtaatactgaatgctatgaacaggtcacccaaagcaaaaggaatgaaattggaaaaaccggacaggacgtacgagataacaggatagaccgagcgtgcatatccttctcccattgccgggatcgcctgagtgacccagacaaggataattaaagttcctaaaacagagtaccgtatgactcgctttttgcttttcattgctacttctttctttcgaggaacaaaagtacatattcctgtccctatattctacttatttttattaattttgcgccaatctttcgcaataaactaataaaatagatatatacaacatggaattagcaagtaagtacaaccctgctgacgtggagggaaagtggtatcagtattggctggaccataaattattcagttcgaaacccgatggacgtgaaccttacaccatcgttattccgccccctaacgtcaccggtgtgctgcatatgggacacatgcttaataataccattcaggatatcctcgttcgtcgtgcacgtatggaaggcaagaatgcttgttgggtgccgggaaccgaccatgcctctatcgctaccgaagcaaaggtggtgaataagttggctgcacagggtattaaaaagactgatctgactcgtgacgagtttctgaagcatgcttgggcatggacagatgaacatggtgggattatcctgaaacagctccgtaagttgggggcatcctgtgactgggaccgtactgcttttactatggacgaaaagcgtagcgaaagtgtgctgaaagtatttgtagacctttacaagaagggacttatttaccgtggcgtgcgtatggtaaactgggacccgaaggcattgacagctttgtctgacgaggaggtgatttacaaagaggagcatggaaagctgtattatctgagatataaggtagagggtgaagacagttatgccgttgttgcgactactcgtccggagacgattatgggcgataccgctatgtgtatcaatccgaatgacccgaaaaatcagcacctgaaaggtaagaaggttattgttccgctggtaggccgtgtcatcccagtgattgaagatgattatgtagatatcgaattcggtacaggatgtctgaaagtgactccggcacatgacgtgaatgactatatgctgggtgagaagtataacttgccaagtattgatattttcaatgataacgggactatcagcgaagctgccggtatgtatatcggtatggaccgttttgaagttcgcaaacagattgagaaagatcttgaagccgccggattacttgaaaagacggaggcatataccaataaagtcggctattctgaacgtaccaatgtagtgatagagcctaaactctctatgcagtggttccttaagatggagcatttggctcagattgcccttgagccggtgatgaaggatgagattaagttttatcctgccaaatataaaaatacttatcgtcattggatggagaacatcaaagactggtgtatcagccgtcagttgtggtggggacaccgcatcccggcttacttccttccggaaggcggatatgtagtagccgttactgacgaagaagcattgaaattggctaaagaaaaaacaggaaacgatcatctgacaatggctgaccttcgtcaggatgaagattgtctggatacttggttctcttcctggctgtggcctatttctttgttcgatggcatcaataatccgggtaacgaagaaattaactattactatcctaccagtgacctggtgaccggtccggatattatcttcttttgggtggcccgcatgattatggcaggctatgagtatgaaggtaaaatgccgtttaaaaatgtatattttacgggtattgtccgcgacaaattgggacgtaaaatgtccaagtcgctcggcaactcaccggatccgttggagttgatagagaaatacggagcagatggtgtacgtatggggatgatgctttcggctcctgccggaaacgacattctttttgatgatgcactttgcgaacagggacgtaatttctgcaataaaatatggaatgctttccgactggtgaaaggttgggagaatggaatgggaacaatcgatattccggcggatgcacacctggctgtacaatggtttgaccaaagactggatgctgccgcagttgaggtagccgatttattcagcaagtaccgtttgagcgaagcgttgatgctgatttataaactgttctgggatgaattttcttcatggttgcttgaaatcgtgaaaccggcttatggacagcctgtaaacggatttatctattcaatgactttgagtgctttcgaacgtctgttggctatgctccatcccttcatgccatttatcacggaagaattgtggcagcagttgcgtgagcgtgagccgggggcaagcctgatggtagaaccgttggcagaagtcggagaagtgaacgaggagttcttgaaacaattcgaaacggctaaagagataatcagtagtgtgcgtgccatccgtttgcaaaagaatattgcaatgaaagaaccgcttgagttacaagtggtaggagtaaacccggtagagaaaatgaaccctgttatctttaaaatgtgtaacttgtctgctattcaggtagtggatgtaaaagctgacggagcttcttcattcatgatcggaacgactgagtttgcagtccccttgggtaatatgatcgatgtggaagctgagatagcacgtatggaagccgaactgaaacataaagagggcttcttgcagggcgttttgaagaaactcagcaatgagaaattcgtgagtaatgcaccggctgccgttattgaaatggaacgcaagaaacaggctgatgccgaaagtatcattaaatcgctcaaagagagtattgcatctctgaaaaacgcgtaagaaagtctttttagaagataaatataaaagggcactctaaaataatagggtgcctttttctgtatacgaataataatgatacctttgtcaccgattttagcaatcgaccgttacaaatgaaacaaatacaattcagatacttctgtttccttctgattctgttgggaggaatgaactgtcggctatcggctcacaaggacaggtccggtgaagatgtgttgtttctgaattctattaactttaatcttccctgggcaaaaagtatatattggtatgtacatcaggaattgcagaaggaagatatttccgtaacggccgaatctctgtctgtaccggccctttgtagccgtaaagaggcaactgcaattgtagaacagttacgtcgaaagcatgatatacctcctcgattggttgtttttataggtgacccgggatggattgtctgtcgggagctttttgatgatgaatggagagatgtgccggtcatcattactaatgcccgggaccgcttgccggcaacacttgatgttttgctgtctcacgaaccgttgactgataccaataccgttccggctaaagaatggcgcaaaggatataatgtgactacattggggcaaacgtattatgtaaaagagactatcgaactgatgcggcaagtgatgcccgggatgaaacgagttgcttttatatccgatgaccgatatatcagtgaggcagttcgtggtgatgttagtcaggctgtgggcagatacttcccggagctgagtctggagcagttgtcaaccaaaaatatttctactgaaatgctgctcgatactttgagcggatatgataaaaacaccggattgatttattattcgtggtttgaatcgcataaccaagacgacaataactatttgtttgatcatattcaggagattattacccgatttgtgcactctcccctgtttttgctggctgctgaggatttatccaataacacatttgcgggagggtattatgtatcggtggagtcattcggagattcattattgcaactgattgaacgtgtgttgaaaggagagcaaccccgcgaaattccgtctgcattagggggtgagccggccgcttatctttgttatccggctttgcagtcctaccaaatccctgtttcgctttatccggaaggggctgtatatgtaaatcttcctatgagtttctttgagcagtataaaaaggagattttactaacggtatttgttgtgcttctggtagcaggtgccattggcttttatattcatattcttaagaaaactcatcaacgcctggaagaggcgcgtctgaaagcggaggaggctaatcaattaaaatcagcttttcttgcgaatatgagtcatgaaatacgtacccctctgaatgctattgtcggtttttcaaacctgctttcgcaggtagaagataaagaagagatgaaagaatatgccgatatcattgaaaccaatacagatcttctgcttcaactgatcagcgatattctggacatgtcgaagatcgagtccggaatgtatgattttcatataacccgtgcggatgtcaatcaaatgatgtcggagatagaacaagtgggtaaactgcgtatcaaatcggaagaactcgttctaacttttgacgaacaattgccccaatgtattttatatactgataagaatcggctgacacaagtcattattaatttgttgaccaatgcgattaagttcacttccggaggggagatacggatgggatatcggttgaaagatgccgcaacattatatttttatgtgtctgatacaggctgtggcatgtctaccgaacagtgtgagcatgtgtttgaacgttttgtcaaatataatccttttatacaaggtaccgggctgggactatctatcagccggatgattattgaaaaactgggaggtgagatcggggttacttctgaggttggtaaaggctctcttttttggtttactttaccctaccggacttctgtatagtatttgctgaatgctccgctgttttaacgcagcaggaaggatagcaggacgggcagataatctttcagatcgatgcgcagttgtttcagtgcctgctgaatccggtaatctatcgttttgggagatactcctaagcgttcggctatttcgttgtaggtcagattctggaaacgattgagctcgaatgcttcgcggatattttccgggagtcgtgccaaagcttcttctattttctcggttaattcttgcatgacgtagaaatcgggatcatcatactgtgattggagattgtcgaaaatcatcttttcgattctttgtttcacttcgttccgattgataagagtcaggcaacgatttttaacagctttgaacaagtaacttttcaaagaagtttcaaatgcctgcatctctttattttcccaaagccagaccattacatccgatacaatctcctgtccgtcgtccggttccacaaacagcctggcgtaagcgcacaaggcgggatagtgccggagaaacagcgcttcaaatgcgtcttcatttccctgttgtatctgataaaaaagaatttcgtcgcttgttgtatgcgatgtattgttgtgcatgtaaaccctcgttttgggcaaaaataatatttttttcaaaaaaaatacgtttttaggttaggagatttctgatttcattcgtcttatctataaaagcacgaattatggatgaatcctattacataaatgagtcaattcttttaagctattttgccggggagcttcctgctgacagacaaaaggaggtagaagagtggattgctacttcggaggagaatacgaagacagcacgggatatttttcagctttaccgggcagccgatacattgaactacatgaagcacgtagattctgttgcggctttccatcaggtaaaggaccgaatacacaaacatcaacatagagtttcatggatggtgtgggggcagcgtattgctgcttgtttggctctgccgctgcttgccaccaccctttatctgattttgaaaaactcccccgtggagtatgtggagatacggacaaatcccggtatggttgctgaagcgaatctgccggatggaactaaagtttggctgaactcgggatcttcacttaaacatcctaccaggttcacaggagatatacgtaacgtagaacttgatggagaggcttactttgaggtgcatagagataagagtaagcgatttattgttaatacgcctttccgtattcagactgaggttttgggtacggagttcaatatagaggcttatcggacggacagtgtggtaagaactaccttagtatcgggctctgtgaaattgtcatttctgggtgagggtgacaagcaacggacctttgtgatgaagcctgatgaggagtttatctataatccgaaaacacgtacagtgaggaccgacaaaccttatgtgaaaacttatacggcctggaaagacggtcaggtggtatttaggaataccccgctgtctgaggctttgaaaatacttaccaagcggtttcatgtggagtttatcgtaaaagattctactctttatggaaattcatttaccggagtattcagcgaacagcacttacctctgattcttgaacacttcaggcttgcttcgggcatacagtatagatttatagaactggaacataacacacagcagacaatacagcagaaaatgaaaatagagctatattgaccatttgaatattaaacttttaaaatctgatacctatgacaacacgtccaccttaaaacaaaaaaacatacaggaaaatattggcgtattttcctgtatgaaagtccaccgtccgcttgtttggcgacaagttgtgcggttaatagaattttttaaatcaaaatcactacaaatctatgacaatttacttaaacttccaatttttcgggaggcagaatatcttttcgcttctgaaaaaaatacctttgtgtatgaaactatcagcgatcatgttgtttgtctttgccagtatggcatttgcggctaagggttatagccagtcagtacgtgtgacattgaatgtcagcaacagcagtcttcagaaagtgctggatgaaatagagaagcagtcggaataccactttttctataataataagcaggtggatatctctcggagtgtgactattaaaagtactcaaaaagagatcagccaagttttgaatcagctgtttgccggtacggatatcggttataaaatattggagaatagtattatcctgtctcctaaacagattttggaaacgactgctgcacaacagcagaccactaaaaagataaagggactggttactgatgaggccggtttacccattatcggagctaatattaaagaaaaggattccggaaacgggacgattacagatgtcaacggtaactttagtctttctgtaggaactaaaagctcaattatcatttcgtatatcgggtacatcaccaaagaagttcctgtgggtaataatacttcacttactgttcggttggccgagaacacgaaactgctcgatgaggttgttgtaacggcattaggtatcaagcgcgaagagaaggctctggggtatgccgtgcaaaaagtggacggagatcggctggctgctgtaaaaacagtgaatgttgctacttcgttaacgggcaagattgccggattgaatgtaaaaaacagtacagagttcaatacagctccttcactctcgttgcgtgcatctgccccctgttagttatcgacggtgtaccttatggtaatgtgggattgaatgatatagcagctgatgatatcgaatcggttgatgtcctgaaaggagctacggcttcggcactctatggtgcccgtggaggtgccggtgcagtgatgattaccactaaaaaaggtaaggaagaaggattgaatgtgactgtaaacagcagtaccatgtttgcagccggatatctgagaaagccggaggtacaaacttcatatagttccgggtcgcaggggacttattccaccggaggatatgtatggggagacaaactggacatcggacgtacagcattgcaatatgatccgtatactcacgaatgggtggatatgcctttggtttcgaaaggtagaaataacttaaagaactttcaagaattgagtttggtgacaaacaacaatgtaagtgtatcccagaaaggtaaatatggtagcgtacgtacttcattgacccatgtatataacaaagggcagtatccgaatcaaaaattgaataagattacttactcagtatcgggcgatatgaaatggaagaaattttcttttgacggaggtctgacttataacaaacgtttctaccccaacgatatgggagccggatatggtggaagtggtttcctttataatttgttggtatggtcaggggctgagtatgatatacgggactataaaaattactggattaaacaggatgaacagcagaactggatggataccaaatggtatgataatccatatttcattgcgaacgaaattacgcgttcaagcgattatgatttgattaacggatatctttctgccaattatgattttactccttggttgaacttatcactgcgtttggggctggactcgtattcacagaaaaaagagtggcggaatgctgtaagtgctgtgggtggttggcataaacagggttattatggtctgcaacgcttaggcggatatagtttaaacaatgacttgatactgtctgccgatcataaattcggtaatttcaatgtcgatggtttcgtgggtggaaacgtttattactggaagagtgataatattttggctgaaacacaaaatggtctgaaaattccgggatattactcattgaaatcatctgtagacccgttgaaaacaaccagtggtattactaaaaaactggtgaccagtgtatatgcaaaagcttctgtttcgtggaagagtactttatttctggatgtaacgggacgtaatgactggtcatcttccttgccgtcggagacacgatcttatttctatccgtctgtggccagcagtgttgtgctttcgcagtttatcccaatgcctaaatttattgatttctggaaagtgagaggtgcatggacacaaactaagagtgacctgggagtatatgatactaacaatacttatagtgtgtctaccgatttgtggaatggtgagagtgctgcatattatcccacatctatccgtggtgttgcggtgaaaccttcggctacacgttcttatgaaatcggtacggcagtccatatgtttaaaaatcgtctgaaagtagactttacttattataataagctctattacaatctgactcgtagtgccggcatcagcaactcttccggatttacgtctacattgatcaacattgatgaagaatatgtgggtcgtggggtagaattgaccctgtcaggcgatattatcagaacaagagactggaattgggagtcggctttcaactggtcacgtgaccgttggtattataccaaaatagacccggtatattctacacagaagccttgggtagctgttggtaaacgttgggattggtacggaatttatgattgggaacgcgatcctcaaggaaatattatcaattacaatggttatcctaaacagagcgattaccagtcggttatcggttatgaatatcctgattggatatggggctggacgaatacgataacttacaagaatttcactctctcctttacacttgacggacgggtaggaggtatggcacactcgaaaaccaatcaggcgatgtggaactcgggggcacatattgattcggacaatcagtggcgatatgatgaagtggtgaataagaagaccaattttgtaggtaccggagtgaaagtcgtttccgggagtgtagattacgattcgaacggaaaaattatccatgacgatcgagtatttgctccgaacgacgtacaagtatcttacgagtcgtatatgaaaagtactaacccgtatataggtaccgtgacacgtcagaatgtatttgacgagacgttcttcaaactgcgtgacctctcgctgagctatcagatgcctaagtctgtttgcaacaaactgcatatgaaaggtttgacactggcctttgtcggacaaaatctgtttgtatggactaaagagttccgctttaccgatcccgacagtgactcagataacctaagttctccgtccacccgttatttaggctttaatgtaaaattggatttttaaaagatagaataatatgaaacgaattaataaatacatatcgttgttattggtaactaccttgctggcttcttgcgataagttcgatgaaatcaacacaaatcccgatgcaaccactaaggtaacctcttcactgctggcgaccggattacttttggatattacatcgtccagtgccagtaaatcatttatatatgacgatctgcttgccaaacagatggcatggggcgaaagtatggaagattaccagtataatgtgttcggacgttccggtttcggaggatacacgacactgattaatgcacagaagatggtcgaatctgttacggatgataatgtgaatgcatacgatggtctggcgcattttataaaggcctacaaaatattctatatgtcgatggaaatgggggaccttccttacgaggaggctttgcaaggtgaattagggttggtgcgccctaaatacaatacccaaaaggaagtgatggggtttgttttgagtgatctggaaagagcatacgaactattttcctcagctaaagattttgatggtgatccgattctgggaggtagtatcagcaaatggaagaaagcgactacagcatttcagttgaaagttctgatgcatctttcgaagaaagagagtgatgtagatttgaatgtgaaagaacgttttgcccggatcgtggcatcgggtagcttaatggaatcaaacgatgataatcttcagatgaaatatgcggataaagcgaatactgtatatcctttccataacacaaatactaaacacgccggttatgccatgctttctactatgctgattgataagtttaaggcaaccggagatatccgtatgttctattatgccaaaccggcaaaggctaaacttgatgcaggagtgaccgctgacagttgggatgcttatatcgggactgatccatcattgccttttgaacagatagagaaggcttatgccacagaacaatattctggattcaatgcgcggtatactgattatccttccggagaaccggttgtccgattgggatatgccgaacagaatttcattctggcagaagctgccgtgagaggatggatttcgggtgatgcaactacttattacaagaaggcaatcagagctcacatggagtttatagctgctaatactccggatgaagagatctatcatcatggacatccgttgacgcaggaagcgattgcggcttttcttgaaacaccggctatacagttaagtggtgagagagagggagaccttgagaagatattgacacaacgttatctggcatcgttcatgcaacatccgtatgatgtttattatgactaccgtcgtacagggtatccggtattaccgatcaatcccgcaaccaaccggaatacgatgaatgacagactgcctatgcgctggatgtatccgaaatcagagtctgattataatctggagcatcagaacgaggctttgcaacgtcaattcgggggagtagatgacattaataaactgatgtggattttgcaataaaatagagttttagaagaggtgtgtgcagaatggagagaaatgctttctgttcgcacctcctctggtttttaatacatttattaatatgatgttgagatatagtttattaagtatagtcttatggctatctactgtaatggcttatggcaagggaaacgaagttaaagtcctccaaatgaatatctggcaggaaggtaccatggtgaaagggggctttgaggcaatagctgacgaggtggctcgtctggagccggatatcgtgatgtttagtgaagtgagaaactatcatggaaaacaatttatttcgcgtatactacaggctttggaagaacgtggaaagagatattatggtgaaaacagcaagttggatgtaggtattttatctaaatataaaattgaagaacaggctcctaattgtcccttggaagatgatgccggttccgtactgaaagcccgcatacgcattaatggaagagatgttgttgtatattccgcacatttggattatacacattatgcctgttatctgccaagaggatatagtggcgttacatggaaaaagttggatgcaccggtactggatgtagcggtgattgagaaagccaataatgaatctttgcgtgatgaagcgattcgtcatgtgatagaagatgcccggaaagaaaaggggaatattgttttattaggcggtgatttcaatgaaccttcacatttggactggaacgaaaatacgaagaaattgtgggatcataacgggacggtagttcggtgggattgttccgttctccttgaaaatgcgggatttaaagatgcctaccggacaaaatatcctaatccgatcacacatccgggatttacttttccgtctgataatgaaggtatagctgtagaaaagctgtcgtgggcacctgacgctgatgaacgggaccgtattgattttatttatttcaggcctgacaaaaaaataaaattgaaggatgtatctgtggtaggaccttcaaaatcgattgtccgcagtaaacgtatagaggagagaagcaaagatttatttataaccccgttaggggtgtggccgacggatcataaagctgtaatggccacttttcttctgaaataattaggaggatacaggggttattgccagtgagtatttatatctttgctacttaattttatttgaaatatttaaatgtaatacttatgaacaggaaaaactacttattagcttttattctttgtatgcagactttatttgtttctgcgcaagtttatccggtacgtgcaaaacttaccgataaaaattctttttcaatgattctgttgcccgatccacagagctatacaaagttcgatgccaaccaacctctttttgagctgcagacagcatgggtggctaacagcattgagtctctgaatataaaaggagtgctttgtaccggtgatttggtggagcagaatgaaatccgtattccggatggagtgaacgggaatcagacaagtgaagaacaatggcgtgccgcttcgcgtgcatttgagcgcttggacggaaagctgccttatgtgatttgtaccggcaatcatgattatggatatcaaaaagcagaaaatcgtttgtgccattttcctgattactttccttcagagagaaattcttgctggagagaaagtctggttgctgtaggaaataactatcagggcataccaacactggaaaatgctgcttatgaattcgtgactgatacctggggtaagattttagttgtttctctggagtttgctcctcgtgatgaagctttggagtgggcgaagaaagtggtggattcacctcgctataaggatcataaggtgatattgttgacgcattcatatctggcatggacaggaaaaataattgaaaaagagaattataaaatgacacctgccaattatggacaagctatttgggacaagttggtctatccttcaaagaatatttgtatggtgatttgtggacacgaatgtgagatagccgattataaggataatgtcagtttccggattgataaaaatgcatccggtaaaaatgttcctcaaatgatgttcaatgcacagacagcagatggacaatggtttggtaacggtggagacgggtggctgagaattatggaatttatgcctgatggaaaaacgattaaaatcaagactttctctcctctttttgctctctctcctctgacttgcgataaatcgtggagaacagattcttatgatcagtttgatattacgatagaataaacagtacatgtaaaggaaggtgtgtcgaaactcatcacagagaacatagaatacacagatgtgtctttaagtcgttgatgatcaatgtgaataatctctgctactctgtgtcctttgtggtgaaaagacttttgacacaactccttctttttattcggtaactctgcctccttttataatgtctatctttcgtctgtgcgaactacgctgccagaaaaattaatgccaatgataagaattccttgagttccttgcgtagtaatttcagtgcctgttgtatacgataatctacggtcttagtagatatattaaggagctctgcaatttctttgtaactcatatccttgaagcggtgcatgataaatgcttctcgataagattccggtaacgctgctatggctgtgtgaatccgttttgttaattcttctatctgatagaagtctacatcgtaaatcattgcctgatttttttcataaaatagtgtatctgcgcgatattttacctctttctgcgcgatgcggtttaatgcacggtgatatatcatttttagaagatattggcttagtgatgattcaataagtaatatctcacgattctcccatagccaaagcatcacatcctgtacaatttcctccgcatcctccaaatccacaaaccggtgggcgtatgcacataacgttggatagtattttctgaacaaggcgttaaaagcctttttatccccttgttgaagtttggaaagcaataaaatctcttctcttgtccggtttggcttcatagatctaagaatttaatttatatacaaagatagtcttttcttattaaaacaaagattttctaaaaaaaaatggaattaagtttaggaatcctattttcccacctgtcttattaataaaagagttgagttataaatatgaatcaagaagatatagaccatttactacctcgctattgtgaaggactggctacggaagaagagtgcaggcaggtggaagcttggataggagaatcggaagagaaccggaagatggttgatcagatgaatactctttatctggctgtagatacagttaacgtaatgcgtaaggtggatacggagaaggccttggataaggttaggagtagaatggttgtaaagaaaacaacttggtgggagtggatacaacgtaccgctgctgttttattcattcctttgtttatagcttttgtggtgcaatacatgaacaatagtaaacctgtcttgagtcagatgcttgagattaagacgaatccgggaatgacaacttcggtggtactaccagatagtacggtcgtttatctgaattcggaatcttctttacgttatccaactttttttgaaggtgatacacgagatgtggagttgcggggagaggcttattttgcggtagcaaaagatttaaaaaagaagtttttcgtctctactccacatgcatcaaagatagaagtattgggtacccattttaatgtggaggcttatgaagatgaaccggacgtctcgaccacgttggtagaaggacatgtttgttttcattttaatgatagagattatcgggttaagaaagttgttatgaaacccggacaaaagcttgtttatagttcgacaagcggtgatgtgcggctctatgctacatctggcttgtcggaaaccgcctggaaagatggcaagatcatattcagtaatacgccgttggaagtagcgttgagaatgcttgaaaaacgttttaatgtaactttcattataaagaatacacgtttaaaaacaaatgcgtttacgggtacattcaccgaacaacggcttgaacgcatattggaatactttaaaatttcgtccaagatacaatggagatacctggagagtcctgatattcaggatgaacggagtaaaattgaaatttattaattaacccttaaaagaaatgcttatgaaaaacaaatctccctgaactactaaaaacgtacggaaagatattggcgtatccttccatacgtaaaagagtaaaccttttgagcttgtttagcgacaagctaagataaactatttttttaactttaagtcaatacaaaattatgcaaaattattttagcatccaattattgcgggtggtaaagtcttcgctttggctgacctcgaataaaataccaagaactatgcgactatttattctattcctaatttgctctatgagttttgtgcatgccacagatgtttttgcacaaaaggtggagatcagtattgatatacataatcaaactgtagagaaagttctgaaagaaatagaaaagcaatcgggctttggctttttctttaataacaaacatgttaacctgaaaaggatggtttccgtttcagttgacaagagtgatatatttaaagtgctggatgaaatctttgaagggactaatgtgaagtattccgttttggataaaaagattattttatctaccgaaatgacatcgaagcaacaacaaacggtaagagtttcgggaagagtgacggatgtgaacggagaaccggtgattggtgccagtgtcgttgagaaagggacaacaaacggtatcataactaatttagagggagagttctccttatcagtgagttcggagaaatcggtgattgagatttcttatatcggatatcagactcaggaactgaaagttgtttcgggaaaaccattgagtgttacgatgaaagaagatacccgggctttggaagaagtggtcgtggttggatatggttcacagaagaaagtgaacgtgattggttcgattgctgcggtggatagtaagaaacttgaatccagaaccgctcccagcgtttcgaatatgctgaccggacaactatccggagtaacaattacacaatcgagcggtaatcccggacaagatcaaggtacaattcgtgtacgtggtgtcggttcttttggagcaacccccgatcctttggtgctggttgacggacttcccggtagcttgaatgatttgaatccagctgatattgagagtatttcaatcttgaaagatgcttcctctgctgctatttacggttcgcgtgctgcgaacggcgttgtacttgtgaaaaccaagggtggtcaaaagggtaaggtcaccgtaagttataacggttatgtcggatttaatcaggctactgaattacctgaaatgtgtgattcgtgggagtatgccgaactgtacaataaagcaatgggcaaggaggtttatacggcagaagagattcagaaatataaagatggttccgatccgtacaattatcctaatgaacgctatctggacaaattattgggtaacaaagggctgcaaaccggacatgaactgactgtgaacggaggcaatgataaaacacaatatatggtttcctttggctatgtaaaacagaacggattgatgaaacacaatcactatgatcgttataacggcagagtgaatctgacgacagaattggctaaaaaccttacattaaccacacgtttaggcggtgtcgtttcaaaaagaagcgagccttctactccgggtggaatggattctgcaggatttaaagctttttcaagcaatgcacttcgtttcccaggattgtgggctaccaaattggaagatggttcgtacggtttaggacccaaggtgcttggtacaccgttggcatggttggatagtggttctttttatgatgaaaactttgataaattccgttctaatgtagagttggcgtttacaccggtgaaaggtttaactttgaaagctatcggaggatataattataccggtcagcagattcgtcactatcgttcggctatggagattacaggcggtaaaaagttgggtccttcttctctgtcggataccatgtataaaacggtctataaaacgtttcaggcattggcagattacaatgtgaaattcagcaagaatgatttgtctgtattagtcggttatacttgggaagatgaatcgcagagaaccgtaggaggaagccgcctgaatttcccatcggatgaagtcccctacctgaacgccggaggagctgatgggcaaaccaattccggtggaggctacgattgggccattatgtctgttttcggacgtttgacttataattatgaccaacgctatttgtttgaaaccacgatgcgctatgatggttcttcccgtttcccgacagataataaatttggtttctttccatctgttgccgcaggatggcgtttatcggaggagcaatttttcaaagaagcagagtcactgagctttattgataatctgaagctgaaagcatcatacggtattctgggtaataacaatattggtaactatccttatcagtctacttatgctcttggaaaagcaatgaactatgtattcgggggtgtttatactcagggtgccgcagtgactacctatgttgatccgactctaaaatgggaaaagacccgtactacggatgtcggtatcgagactgctttctggaagaacaaactgacgtttaatgcagcttatttctatcgtaagacaacagacatcctgtataaaccgagcgcaagttattcttctattttcggtcttgcactttcgcaagtcaacacgggaagtcttgaaaacaagggatgggagtttgaaatagggcaccagaataaggttggtgaatttagttatcatgttaacggaaacttttccattatcaagaataaagtgatcagtctgggtgtaggagatgtggagcaaaagagtggaatgataggtaatggtagcaatctgttcctgggttatccgatgaatatgttttacggttataagacggatggcgtattcttgactgatgaagaagtaaaagaatggcatgatcagagtaagattgctcctaactccaaagcgggtgatttgcgttatgtggatatttccggtgacggaaaggtggatgaagccgataaagcttatttgggatcgaagatacctcaatatacatttggtttaggattgggtgccgaatacaaaggattcgattttaatatattgcttcaaggagtggccaaagtaaaagggcagttgactaattatgccggttatgctttcttccaggaaggtaatatccagaaatggcaggcagaagagacctggacgaataatcagtcgaaccggtatcctaagtatccccgtctcgaggtgatgtcgaatgcgggtagcaacaatacgctgggttctgacttctggattctggatgcctcttatctcaaagtgagaaatatccagttaggatatacattgcccaaacatataactcagaagttcggttcctccaaccttcgtttttatatatcacttgataatccattctccatcagcggatatcgtaaaggctgggatccggaaattaatacagacggtagttattatcctattctgtcaacttatacatttggtttaaccttaaaattttgatgtaagatgaagagtttaaaatatatagtagcattggcattggcggcaggactgtttcaagcttgtgatttagagcgctatccactgacagacttgtctgaagagactttttggaatagcgaatcgaatgcggaactggcattgacttctctttatagaggaagcctgacagacggcgtagagtataacccttcggattggtggtcctatcacggaatgattatgatggagcatctttcggataatgcttttgaccgtcggggggagaataatcctttcttcaagatttcaagtggtaatttgacggctgataatgcatttattaaaagatattgggaaacgtcttataagagaataggttactgcaatcgttttcttgttggcattcagaatagttccgaatcggcaaaaaagacacggatgattgctgaggcccgctttttacgtgcaacccagtatttttatcttgccagctacttcaaggatgttcctttggtagagaatgtgctgacgggtgaagaagccaacaatgtgacaaagacttcacaagccgatatcctgaaatggtgtgtaaccgaatttactgcagctgcggccgatttgccccgtttctccgccattccggcgggagaagccggacgtgcttgtaaacaggcggcccttgcttttctcggacgtacctgcatgttgcagaaagattggaaaagtggagcaaaggctttccacgatattatggaattgggagataatgcgataaacgccaactatcaggagctgttttatccttctaccggaacttcgaacaaggagaatattttctacatccagtatctggaaaactatctgggtaccggtctgccgcagcatgcactttctgccaaagacgggggctggagcctggtcaatccggctgctgatttatacgaatcgtatgaatttaaggatggaactcctttcagctatgatgatccgagatatgacccgtctaatttaggaaaggatcgcgatccgcgtctggattatacaatttactataatggtgccatctttatgggtacagagtataagatgagtcctgactatagtgcagccaagaaagagaagctcgattatacgagcgaggcttccagaaccggctttatgatgaggaaatattttgaagaatcgacacctataaacgatgtacagagcgcaaacggactgactccgattattcgttatgccgaagtgttgttgggatatctggaatgtctggttgaagataatcaaacgatcactcagggaacattggacgagacaatcaatgcagtgagaggtcgggccagtgtgaagatgcctgttattaccgaagtgaatccggctaaacttcgtgagatcgtgcgtcacgaacgtcgcattgagttggctatggaaggtattcgctactgggatatcatgcgatgggggattgcacatgaagtgttgtcccagaaaatatggggtgctccctatccaaattcaactcagtatgcaacaacgaccaaggaggttgatccgacagggaagtgccgttggtatgttggaaaacgtgctttccgcaatccgacagattatacatggccgattccacagtctgaacagaatattaatcctaatttacgcgactaatttaatagcttaagtaatgagacaatatgtattattggcttgtctctctccggtagcatgcctgatggctgctaccggtcagaagggagggaaagcccaacaaaaagttaacgatcggaagctccccaatgttgtgtttatctatgctgatgacctcggctatggtgatttggaatgttacggtgcaaagaatgtgcagacaccccatgtaaatcgtttggcagctgaggggatccgctttaataatgcccatgctacagcagctacaagtaccccatcccgttattccatgcttaccggagagtatgcctggcgtcgtccgggcacggatattgcggcaggcaatgcagggatgattatccgccccgagcgttatacgatggctgacatgtttaaaaacgccggttatgctactgctgctatcggcaaatggcatttaggattgggagataaggatggggaacaagattggaatgctccgttgccgactgctttaggagatatcggttttgattattcctatataatggctgcaaccgctgatcgtgttccgtgtgtttttatagaaaatggtaaggtggccaattatgatccctctgctccgattgaggtcagttatcgtaaaccgattgaaggagaaccattgggaaaggatcacccggagttgttgttcaatctgaagtcaagccatggacatgatatggctattgtcaatggcattggtcgtatcggatatatgaaagggggaggcaaggccttgtggaaagacgagaatattgctgattcgataacttcacatgccataggtttcattcgtgagcataaggacgagccgttctttatgtattttgcgacgaacgatgttcatgtccctcgttttccgcacgatcgcttccgtggtaaaaatccgatgggattgcgcggagatgcaatagtccagtttgactggagtgtaggtcagattatggatacgcttgataagctgggattatcagaaaataccctcattatactgtccagtgataacgggccggttgttgatgatggctatcaggatcgggcagaggagttgctgaacgggcatagtcccgcaggaccgttacgtggtaataagtacagtgcttttgaaggtggaacccgtattcccgctattgtccggtggccgaagggagctgcttcagccgaggtttccaatgctttagtttcacaaattgattggtttgcttctttggcttcattggttggagcagggctacccaaaggagcggcacctgacagttttaactttctggatacttggttaggcaagaatcagtccgatcgtccatgggtgatagagcaggcttcaaatcacactttgtcggtccgtaccaaagattggaagtatattgagccgaatgacggacctgccatgattacctggggacctaaaatagaaaccggtaatttgagtaccccccaattatatcatgtagcagatgatgtggcggaacggaagaacgaagcttctttatatccggagcgggtttttgaattacagaatatattaaggcatgtccggatgaaaaatctgaaaccttagaaaacttcttggcagaaacaggatgccgtcttaatgataatatcgttgaggcggcatcttttttagatgtgctttatatttaatttcattattttcatgacagaacaagattcttgcctatctttgtactcaggctccattgacctcatcagaaattactcttgaacaaatttaatatgacaaacgaaaaaatgaaattgctaaactgtaccttaggggtggtagcgggggtatctttgccggctactgctttggccggcgcgccgcagtctgcacaagaacaaacagaaaaacagcccaacattatcctgattgttgccgatgacttgggatacggagacttaagttgttatggtgcccatcgaatacagactccgggcatggaccgtatagccaatgaaggtattcggtttacacagggattctgtaccgcggctacgtccactccgagccgttattcggtcatgaccgggaagtatccctggagcaatgtcgaagctaagattttgccgggtaatgccgcgttgattattgatccacagaagataacattgccaaaactgatgaagcaggcagggtatactaccggttctgtcggtaaatggcatatcggtctgggagacgggcatgtagactggaataaggaggtacatcctggtgctgccgagatcggttacgattattcattcattcaggcagcgacgaatgatcgtgttccttgtgtttttctggaaaatggaaaagtggtcgggctggatccgaatgaccctctttatgtggattatcggaaaaatttccctggcgaacccaccggtaaagacaatccggagttgttgcgtatgcaccccagtgtggggcatgcaggttccatcgtgaatggggtgcctcgtattggtttccagaaaggcggtaaggcggcacagtggaaagatgaagaaatggcaggattatttctggataaagccaaacaatttgttgatgaaaacaaggataaacctttctttctctattatggacttcatcaaccgcatgtacctcgtgtgcctaacgaacgttttgtcgggaagtcgggtatggggcctcgtggcgacgtgattctggaagctgattggtgtgtagatcaatttctgaaagaattggataaactgggattggcagagaataccatcgtgattctgacaagtgacaacggtccggtacttgatgatggctacaaagatgatgctgttgaattggtgggtgatcaccaaatagccgggcccttacgcgggggtaaaacaagcatgtttgatgggggaacccgtataccatttatgcttcgctggccggccagggtgaagcctcaggtatcagatgtatttgtttgccagatggatctattagcttcatttgcttcacttctgggacaaagttatcctgataaagtggatagtcagaatacgatggatgcttttttaggtaagagtaaaaagggtcgtaaagagttagtgatcgaagggatgttcaattatgcttatcgtcagggtgactgggcattgattcccccttattataatccctatagtaaagaagacggtgactttatcggtttaggctatggctataaactctataatctgaaatcggatatcggtcagcaggagaatctggcagagaagtaccctaaaaagttgggtgaactaatcaatcgttttgaatacctgaaggcgcattcggacaaggtgacaaggtattgattatccatatgtccgtcatgaacccaatccaaaagaggctattcgaattattcggatagcctctttcagttatatcacaagaagggggcggaactatttttccaataagtttttcagaaaatcgtccagttctttatccagccctttcagaagttcatcatttactaacagtgtatcatcgtctacaagcaaaaggtcggagatcgtctctttatcttcgtctaccaatacgaaagaataaggtttaaggatagtcaacttatcgaaacttccaccttctttcatacggcagagcatggtgcggaagattctttcagcatcttcgtaaaagtcatctccctcgtaggctgtccattcatcaatggttacactggataattcttcatcttcatcatcatagatgaagagctcaccggaattttggttcggttgaatatggatatctgtgacgatggtctgttcgcatccacaggtatatttgttaattgctttttgaatcgcagattcgataatggcttgtgactgctgactaagtttcatatcttttagctctttttatttagctcaaaggtataaaaaaaataagaacccttgcatgatttctttaaaaatcatcattaaatctactcatttggcctttaagtttgcctaatccctcggccctttccttcaattcgttcacataaaggctggtcaggtagtagttgggaattctgctaaagtctatatcactgctcttcagtgaatcgattttatctattttacgtgcaaattcctgtgctttgatagcccatttctctgcttcttccacactatctttcatttcgtggtatagggccagattgaaagctgcacgcattttctttttgttatttttagttgcttcgaaagcttgttcccaaagttttgatgctttgtcccattcattttctttcacatagacggctgcgtcgcgcattgctaccgagccactgatgaagtaataacgataggctgttttccagtacggcagtatcttgcttaccggaatgctaccggcaaactcagaggattcgcgaatcatttgtttgtcatccgggagacgtgagcggacaaacgcttcggtatttccgtactcttcccaaaaaatgctgtcgttgctgttgatcgttaccatcgggcttttccgtcccggaagataaatcttcaccgtaggatagattttagtatctaatgtaccataataagtgttccattcgggaatataactgaaaacacgtgttgatttcatttgcaagttttcaagtgaaatgatgaaatcaacacctaaagtctgtgtcaaggtccggacctcttcttggctgagggttgattcacgaggtctgaagtcccgtgcgcgcagagccgaatcacaaataacgacttcgttaaaataattctgctcagctatggctttggccagtgcctcggtagtgagcacgggctggccgtcgtgataggatactgcccggctgagttcatttttatcttttattttattttctttgggaggtaaggtattatcaggtgtggcactgacattatttacgattgccacccgtttcaactcgttaggaaaactgatttccgcagggagcatataatcaatggaaagttgctcaacagtctggcaggaactgaaagacacaaggagcaatacgaacagaatatacggatattttgtcatagcctgtttttttacttttctgaaagaacaaaaatacgattttgattgaatatagaaaagcctcgaacagtttttaaccgttcaaggcttttattaaggagttacgggttctttatatacttaactgttccgtccgtgacaatttttatatttttttccgcttccacatgggcagggatcattgcgtcctactgttttttcggcacggatgggttcacgtttcacggcttcgcgcgtatcttgctgggcagcggcctgctgattcggatcactcagatcttgtttttgttcccgatatttgctcatgtcctgacgttgttccggagctgcctggcgtacttctacgcgtctggccgcttcttgctgttcttcagttggttcggctacaggaatctgaccacgcatcaggatggatacagtctgattattgatcttgtttaccatattatcaaacaaagtcaccgattccagtttatagatcaatagcggatctttctgttcgtaacttgcgttctgtaccgaatgtttcagttcgtccagttcacgtaagttttctttccaagactcgtcgatgacatggagcaagatcgatttttcgaatgatttcactacttctttcgattcgctttcgtaagcagctttcagattgcaagagatattgtacatacgttttccgtccgtgatcggaatcaggatgttttcgtacatatgtccttggttctcgtacacttgcttgatcaccggattggctatctgtgccagacgttctgtcttgcgcttgaagttagccattgccacatcgaatgttttatctgccagtttatcctttttctcgttgcggaactcttcttctgtgaaaggaacctccattgcgagcgtttggagcaagtccagcttacattcttcgtagtctgcattgttctcgatagcggcggcacaacggtcccaaatcatattaacgatatccattccgatacgttcacccatcagcgcatggcggcgtttggtataaacaaccgtacgttgcttattcattacatcgtcatactccaacagacgtttacggataccgaagttgttttcttctacctttttctgtgcacgttcgatggagttggagatcatcttgtgctcgatcatttcaccttcctggaatcccagtttatccatcacgctggcgatacggtcggaagagaagaggcgcatcaggtcgtcctcgagtgaaacgaagaagacagatgaacccgggtcaccctgacgtcctgcacgtccgcgcaactgacggtctacacgacgtgactcgtgacgttcggtaccgatgattgccaaaccgcctgctgcttttacttcaggactcagcttgatgtccgtaccacgaccggccatgtttgtagcaatggttaccgtaccgctcaaacctgctttagcaacgatgtctgcctccctctgatgaagtttcgcattcaatacgttgtgttcgatcttgcgcatggtcagcatcttgctcagcatctcggagatttctaccgaagtagtacccaccaataccgggcgtcctgcctgtaccagttgttctatttcttcgattacggctttatacttttcgcgttttgttttataaacgcggtcattcatgtctttgcgggcaatcggtcgattggtcggaatcacgactacatccagtttgtaaatgtcccacaactcaccggcttctgtttcggccgtaccagtcatacccgagagtttatgatacatacggaagtagttctgcagagtgatggtggcaaaagtttgtgtggcagcttctactttcacaccttccttcgcttcgatggcctgatgcagtccgtctgagtaacggcggccttccatgatacgtcctgtttgttcgtcaacgatcttcacttgtccgtcgattaccacatactcatcatccttttcgaacatggtgtatgccttcagcaactggttgatggtgtgtacacgttctgacttgatggcataattggtcagcaaggcatctttcttttcaagcttttgttcgtcgctcaatccatgttcgttttccaattccgaaagttgggcggctatgtccggcaatacgaataaagtcggatcttccgagttaccggtgatcaggtctacacctttatctgtcagatctacgctgttcaacttttcgtcaatcacgaagtacaatggatctgttgcttcatgcatgcgtttgttgttttgctccatgtagatctcttccgttttcagcataccggctttgattccctgttcactgaggaatttgatcaatgccttatttttaggcagtgctttgtggctgcggaacagagcgagaaatccttcttccacctctttcttatcattcgagttgataagtctcttagcctccgataagtatttagttgctaactctttctgtttctccacaaggcgttctaccaatgggcggagttgctcaaagagttggtcttcgcctttgggcacgggacctgaaataatcaacggagtacgggcatcgtcaatcaataccgagtccacctcgtcgacgatggcatagttgtgctggcgctgtacaaggtctttcgggctgatagccatattatcacgcagatagtcgaaaccgaattcattgttcgttccgaaagtgatgtctgccaaataagcctggcggcgtgcgtcagagttgggttggtgacggtcgatacagtccacgctgagtccgtggaacatataaagcggtcccatccattcggagtcacgtttagccagatagtcgttcacggttactacatgtacgccgtttccggtcagggcattcaggaatacgggaagcgtagctacaagagtcttaccttcaccggtcgccatttcggcaattttccctttgtgcagtactacaccgccaaacaactgtacgtcgtagtgaaccatgttccataccgtgtcatttccaccggcattccaatgattctgccagatggctttgtcaccttcgatgcgtacgaagtctttggtagccgccagggtacggtcgaaatctgtagctgtaactactatttcttcgttttcagagaaacgtttggcagattctttcacgatggagaaagctaccggcaatacttcgtcaagtgctttttcgtatatctctaatatttctttttcaattttgtcgatctgagcgaatacttcttcgcggtcttccagttccacgctttcgatgcctgctctgagttcgtcagctttagcacgttctttgcttgccgagttgcggatgtattctttaagttcctctgtttttgcacggaggccgtcattgtcaagcttagcaacctctgggtaagcggctttgatcttgtctacccagggttgaatttctttcatgtctcgtgtggatttgtttccgaaaatcgagcttaaaaattcattaaatcccattatctattatttatgtttattatttactaaattgattcaactgcgcaaagttacattaaaatgctgatttatttgcgctttgcacactgttttttgtgtggaaagtgtcaccggatgtcggtaatcggagttgcagtgcatgcgttcggggcccgtattctcaggatgtgagctacggtaggagctatgtggtcgacggttacgggcgtgttgattacggccggttttacgccactgcccagaaaaataagcggagacggaatatgtgctttccggatcactttatggtcggatgtattttcattgacgatggtccagcccggcaatacgtcgatcaacagatcgcccgagcgtttacggtggaaaccattccgtatcattgagatgtccggtgtccaggcccccaataacaggcgtttacccgaataaacctcgtttaccccactaaactggatcaggaattcagcggctttttcctgaatatctgccaaatccagttgtttttcttctatcagtttatggttgagataaatttgctggtcgtagtaggcttccacgtattgtccctgaccgtaagtagccatcagatacatgttcaacagggccgcacaacggttcaggtggaactctccggtcggaacccggtagagtccccggtctgccgattcagtatcggtatatccggtggaagtgataaagaagacaacgttctgtaagcctactttcttgtcgatgatatccagcaaagaagcaatgctgcggtcgaggcgaacgtaggtatcctgcatctccatagcgcattcctgtacgcttttgtgagcataattgccggcgtaataggtgagtgagagcatgtcgggagtattgtcttttcccattgtgctcttatccagaagctcctcggtcagcaagttaacttcatcgttgataaaagggcttgtaatcagccgtttgtatttattgatgcggtcatcgtcaaatttatatttaaaggctgcgtccctccattcgggtaggaatgtgtaattttgcatggggtggacaggagtccacgtcatatcggcaatgcggaagtctacggcattccgatcgttatattggctcacccaccatgggaattcactataataagttgttccgcaccatttgccggtagtattgttaagccagaatgcgccatttccggcatgtccggctgcaagaatggcagcgtcacggaagggggcgatggcatatactaatccctcgttgcgggtagctattttgagttcatcggcaattgttgaggttaggagatgtgaaggagaagagctttcattcgtgtaattacccatgaatgaaggatcgtctacacaactcacggtgcgcaggatcgatacatccatccagcgtttaccgatgattccgttgaccgaaggagtggtgcctgtataaatggctgcgatggccgatgcgcggtctgtgccacagaaagtatattcggcattccggaatacgcgtccttctttccaaagccgcctgaagcctttgtcgccatacaaagttgaaaaagcttccagatagtccgtacgtaactggtcgattgtaagtcccaccactaatttcggagtagtgggaagtggctgggcttgcagcccggtaaaagtaagtacggtcagtatggaggttaatagtcctttcatttagcttttttgtatgtcagtataaggttgcttgcagaacgtatcagcaaactgagtgccaaaggtaatactgctaagtcgaaattttgtggtattacagggaaaaacgctataaaaagtgttaaaaccatgcaattcagcagatgatacctacttttgcgctgcttccgttcatcgtttatgaagaaagggaggcagagcagatgtcccgggtgaaagacaaataacaagtaattcgcccccaccgtgggatgctcggagaaaagagcaaggaaagcaataatgcatcctgcgatacctgctgcggcgaatactgctatatccagtccccaaagacttttcttttttcgcaggccatagaccgtagctatgccgatgccgataaaaaacagaagagataggcggatgggggtaagtgtatcccagatgtcactttctgcaggtgcggatacgtccggttcgcagtcgataattttttgagtggcggtcactaacggtctgttttcggatgcgttaacgatgcgcgctttgtcaaaagcatccatcagatagaatggtgagaacatcatttgtctttcgctgatggggcggtcggcctggctgccgatgcagaagtcgattccgaattgtgcccaggggtgtcctttcgtgtattggtgaacaatatctcgataagatttagtctcgttattttcggtatatgtattgctgaagagcagttggctgccacttttttgcaggctctcttccactttgtcccgtggtcgggtagcacaattatcgtagaaaaaattatagcggtatatccggttttccgggcggtaattttcttccagaagggtgattaactgttgttgttcttcggctgtcagattgagcgtctgctgccatacactgcgtccgaagtattcatattcgacggcaaaatgacggtaatcttccactcccaaccggtagtcggcattgccgagtgcaaaacgtagcgtaaagttaggggtgttgaaactgaacaggccgtagttgtacaccctatcgataccccgtgccggttcttcatagcggatggcagtatgtccgaataacgaatagatttcttcccccggagcgcacgtcagcaggctgattcggacagaatcaggcgaggatggactctctgttccccatgtcaggatggtgaagaaagaaaaaaatatcaggagcaaatgtcgcaactttgagttcatgtggcaaagatactgcttttgcgggataaaatactcgattaagtgaataaatctgtcactttttcccgaccgccgggctgtttgtgtcggagcgccgggctacagattgcggagcgccgggctgcatacatccgaccgccgggctacggggccggagcgccgggctacaaatctttttgtgataagtttaccggggatggcatcggcagcggcggtatcttgtttcttctgttattgttatgttctgtattgtattgttctgtattgtattgtaggtttttctgggtttttatacatacgtaaggcgttgctaatcaatggtgaaaactggatgtttggttttgggttttctgccttccttttcgtgtgctttttcaggcgggttttctgttttaaaacgtgtttcttcgatagctcgtcaagtcgtcttttgggggcttttctttgcctcccaatgctttttatttcttatttcagtatgcaaataaattttatcccttatctttgcaccctcaaacagagagaaagtgaacttaattatcgatattggaaatacagtagccaaggtagcgctttttgaccaaacttctatggtagaagttgtttacgattctaatcaatctctggattgtttagaggcagtttgcagcaaatataatgttcgaaaagcaattgttgccactgttatagacttaaacgaatgtgtgttggctcagttgggtaagctccctgtacccattttatggttgaattgcaatacgccgcttccggtaacgaatctgtatgaaacacctgaaactctcggctatgaccggatggctgctgttgtagcggccaacgatcagtttcccggtaaagacattctggtgattgatgcgggtacatgtatcacttatgaatttattgactctttggggcaatatcatggtggaaatatttcgcccggattatggatgcgtctcaaagcgcttcatcagttcaccgggcgtttgcctttgatcaatgcggaaggacgcctgccggatatgggaaaagatactgaaacagccattcgttccggagtgaaaaaagggatagaatacgaaattgcagggtatattacggctatgaagcataaatatcctgaacttttggtttttttaacgggcggagatgatttttcttttgatacgaaattaaaaagtgtcatctttgcagatagatttttagtgttgaaaggattaaatagaatattaaactataataatggtaggatataaacagacactttgtgcgcttctgctcacgatattattacccggagtggcaatcgctcaaaataatacaaactctccttatacacgatatggctatggtcagttggctgatcaggcatttgcaaatagtaaagcaatgggagggattgcttatgggttgcgcaatggatcacatattaatccgttaaatcctgcttcttacacagcgattgattcgttgacttttctttttgacggagggttttcgatgcaaaataccaacttcagtagtgaaggtacaaagctgaatgcgaaaaattcaagttttgactacatcgccatgcagttccgtttgcaaaaatggatagccatgagtattggtttgttgccctattcgagtgttggctatagcatggcaaaagcagataaagacgttgcgtcggaagatgcgcagaatgtgactacattttccggagacggtgggttgcatcagctttatgtaggttttggagtgaaagtgcttaaaaatttgtctgtcggtgcgaatgtgtcttacttttggggcgaaataacacgtacggcacgcattgctttcccaaataatgaaaatgcttttgcttttcaaaatgttgattatttgtccgttcgcgactataaattggattttggggcacagtatacacaacagtttggcagaaaacatgctgttactttaggagttgtgttctcacctaaaaaagatttgcataatgaagcttatgtgcaaagggcaacacttaccaattccaatagtaaccagacagttgctgtgagcactatcgatacggtggccacctatgggacaccaaacagttttggagtgggactcacctacgaatatgacaaacgtctgatcattggtgcagattttaatttgcagaaatggggagatgtaacctatatgaatcagcctaacgccttttgcgatgcaatgaaaatttcagtaggtgccgaatatatgccgaatcgtttttcacgcagttatctggcacatattaaatatcgtgttggcggatattattcggaaccctactataagatagggggagagagagcttctcgtgagtatggagtgacagccggtttggggttaccgcttccggggtcacgttcgctaatcaatgtttcagcccaatacattaaagtacacggactgagagctggtatggtagatgaaaatacattgcggttgagtcttggaattacctttaatgaaggctggttcttcaaacgtaaagtaaaataatagaaagaatagacggtattatataacaactaaaatttagatacaatgaaaattaaaacgcttgtggctgtgttgtttctttcggcgggagcaacaactgtggtagcacaggacgacgctaattgtaattcgaacagtagtatttctcacgaagcggtgaaagcaggcaactttaaagatgcctatactccgtggaaagctgttttggagaactgtccgactcttcgtttctataccttcacagacggttataaaattctgaaagggttgctgggacagatcaaagacagaaattctgctgaatacaaacagtattttgacgagttgatgaatacccatgatcttcgtatgaagtatactcaggaatttttgggaaaaggtgtgaaagtatcatcagaggacgaagctttgggaatcaaggctgttgattatattgcctttgctcctaaaatggatgtaaaccaagcttatgagtggctgaaaaagtcggtagatgctgtaaaaggtgaatcttcgggagctactatattctacttcctgcaaatgtcacatgataaattgaaaacagatcctgcccacaaagaacagtttattcaggattacctgagtgcatccgaatatgtggacgctgccatagctgctgctgataaagagagtacaaagaaagcgcttactggtatcaaagacaatctggtagctctgttcatcaatagtggtacagccgattgcgaatcactgcaagcgatctatgctcccaaagtagaagctaatcagacggatctggcttttttaaagaaagttatcgacattatgaagatgatgaaatgtacagatagtgaagcctatcaacaagcttcattctatgtgtataaaatagagccttcagctgaagctgctacaggatgtgcctaccaagcttataagaagggggatattgaaacttctgtgaagttctttgatgaagcgattaatctggagacagataatgcgaagaaagcggaaaaagcttatgctgctgccagtgttttaactactgctaagaagttatctcaggcaagatcatatgctcagaaagcaatcagtttcaatgaaaactacggtgctccttatatccttattgctaacctgtatgcaatgagtccgaactggagtgatgaatcagcattgaataagtgtacttattttgtggttattgataagttgcagaaagctaaatctgtagatccgagtgttgcagaagaggctaacaaaatgatcggtagatattccgcttatactccgcaggctaaagacttgttcatgttgggttacaaagctggtgaccgcatcactatcggtggctggattggagagactacaacgatcagataaatttatgttgcgacaacaaagtaacagtttattaaataaaagtttgagcataacaattgtcttcggggcaattgttatgcttcttttattttcttcctgtggcggaagaaataaggcaatggccgatgccattaccgaacgggattccctgcctgtcatggacacgcgaggggtgacgactcttatatccgattccggagttacgcgttatcgggtcaatactgaagagtggctgatttttgacaagaagaaaccctcgtattgggcctttgagaaaggaatttatttggagcagttcgactccttgtttcatgtagatgcaagtataaaggcagatacggcttattattacgaccgtgaccggctttggaagcttattgggaatgtagacattaaaagtctgaaaggagatcatgtcagtaccgaattattatactggaatgaagccaccaagaaagtatataccgataaatttgtccagatggagcagcccgatcaggtgataaccggatatggttttgagtcggatgaccggtttttgaagccggttgttcacaatattgccggtatattttatgttgaccaagatgccgaaaaggcaaaaacagattctgtaaattagttatgagtatcattatttacctgttgataaccatggcattctccgccttcttttccggtatggagattgcttttgtttcggtagacaaacttcgttttgaaatggatcggaaagggggagtgtcgtctcgtattctttcgcttttcttccggaacccgaatgattttatttctaccatgttggtcgggaataacattgctttggttatctatggtatattgatggcacagattatcggtgataatttgctggccgggtggattaccaatcattttgtgatggtattgatacagaccgttatttctacattgattatcctggtaacaggagagttcttgccaaaaacgctttttaagatcaatccgaatctggttctgaacgtatgtgcgcttcctctttttatctgttatatcattctttatccgatatccaaattctcgtcgggagtttcttatcttttccttcgcctgttcgggatgaaagtgaataaggaggcttcggcaaaagcttttggaaaagtagacctcgattattttgtccagtcgagtatagataatgccgaaagcgaagagaccctggatacagaagtgaaaatctttcagaatgctctcgatttttcgacggttaaaatacgagattgcattgttccccgtacggaagtagtagccgttgcattggatacctcgcttgaggaacttaaaaaccggtttgtggaatccggaatatcaaaaataattgtttatgacggaaacatagacaatgtcgtggggtacattcattcgtcggaaatgttccgtaacccgaaagactggcgcgaccatgtgaaagaggtacctattgtgcccgaaacaatggctgcccataagctgatgaaactgtttatgcagcaaaagaagactattgccgtagtagtggatgagttcggaggaacttcgggcattgtcagtctggaagatcttgttgaagaaatttttggtgacatagaggatgaacatgacaatacttcctatatctgcaagcaaatcggagagcatgaatatgtgctctcggcccgtcttgaaatagagaaagtaaatgaaactttcgatttggacctcccggagtccgatgactatctgacagtgggaggattaatcttgaatcagtatcagagtttcccaaaattgcacgaattggtatccgtgggtaaatatcagtttaaaataattaaggttacagcaacgaaaatcgaacttgttcggctgaaagtgatggaataatgatcgataactgtaattttttagctaataaatagatgcatattagcattttttgtatcttcgtgcgctaaaaccaaagatgaagaaaataataataacaaataaatcgtattaatcaaaatggcaacattacaaaacattagatccaaaggacccctgttggtgatcgttattggtttggctttgtttgctttcattgcgggcgatgcctggaaagttctccagccacaccagtcgcatgatgtaggcgaagtcaacggagaaactctttctgctcaggactaccagaatatggtagaagaatatactgaagtcatcaagttctccagcggaatgagttcattgaacgatgaacaaaccaatcaggtgaaagacgaagtatggcgtagctacgtgaacaataaactgattgaaaaagaagcgaagaagctggggattacagtttcaaaggctgaaattcagtctatcatcaacgaaggtgtgaatccgttgctgcaacagactccgttccgcaatccgcaaacgggtgctttcgataaagatatgttgaagaaatttttgtctgactattctaaaatggataaaactaagatgccgtctcaatatgtagaatactatgaaggcatgcataaactttggtcattcgttgaaaaaactctgattcagagccgtctggctgaaaaatatcaggcattggtgacaaaggctcttttctctaacccggttgaagcacaagatgctttcgatgcaagagtgaaccaatcggatgtactgttggctgctgtgccttattcttcaattgttgattctaccattacagtgaaagagtcagagctgaaagatctctataataagaagaaagaacagttcaaacaatatgttgaaacacgcaatatcaaatatatcgacgtacaggtgactgccagtgcggaagataaagccgctattcagcaggaagtgactgattatacaaatcagttggctacagctaatggtgattatactactttcatccgttcgacaggatctgaatatccttacgttgatttgtattatactaaaagagcttttccgtcagatgtagttgcacggatggattcaacttcagtgggacaggtatacggtccttattataatgccggtgataataccattaactctttcaaggttttgtctaaagtggctgctgccgattctgtacagttccgtcagattcaggtttatgctgaagatgctgctaaaacaaaagttttggctgatagtatttatacagcaattaaaggtggggccgacttcaccgctttggctaaaaagtatggacagacaggtgaatccaactggatttcttctgctaactacgaaaatgcacagattgatggtgacaacctgaagtttatcaccacgatcaacaacctgggagtgaacgaactctctaatgtagcattgggacagggtaacatcattttgcaggttactgacaagaaagctgtgaaagataaatataaagttgccgtaatcaaacgcgcagttgacttcagtaaagaaacttataataaggcatataatgacttcagtcagtttatcgcagccaatccgacggtagaaaagatggcggctaatgctgaagaagcaggttataaattgcttgaaagaaatgatttgtatagctcagaacacggaatcggtggtatcagaggaaccaaagaagctctgaaatggacatttgctgcaaaacccggtgaagtttccggtttgtatgaatgtggtgagagcgatcgtatgctggttgtcggcctggttaacgtgatcgaagaaggttatcgtcctttggctcaggttcaggatcagttaagagcagaaatcattcgtgataagaaggctgaaaaaattatggctgacatgaaggctgccaatgcaacttctttcgatcagtataaatcaatggccaatgcagtgagcgattctgtgaaacacgtaacatttgcggctcctgcctatgtagctgctttgcgtagtagcgaaccgctggtaggtgcttatgcatcggtagccgatattaataaactgagcactcctatcaaaggtaatggcggtgtatttgtattgcaggtatatgccaaagataagttgaatgaaacattcgatgccaaggcagaggaggttactctggaaaatatgcatgcccgtctggctgcccgtttcatgaacgatctttatctgaaaggtgatgtaaaagacaagcgttacctgttcttctaaaaacaagactcgttttttattaaaaatagttttatagataaaaggtcattccttgtggaatggccttttctttttgttctctctttccttcttcttattaacttttgtcctttctcttttcaaaaatcaacttttattccttacatttgcatgaataaataaatatttgtagtaaatatgcccaaatatccgcttttaggaatgactcttgccgaattgcaatctgttaccaaagacttggggatgccggcttttgcggccaaacagatagcttcctggctgtacgataaaaaagtgacttctattgacgaaatgactaatttgtcgttgaagcatagagaattgctgaaaggcgagtacgatttgggagtagtcgcacccgtggatgctatgcgttccgtagatggtacggtgaagtatctttatcgcgtgggagagaaccattttgttgaagcggtatatatccctgatgaagaccgggcgacactgtgtgtgtcttcccaggtggggtgcaaaatgaactgcaaattttgtatgacgggcaagcagggatttacagcaagtctgactgccaatcagattttaaatcagattgcggcattgccggagcgggacaagttgaccaatgtcgttatgatggggatgggtgaaccgcttgacaacttggatgaagttttaaaagcattgcatatcctgacagcttcgtatggatacggttggagtccaaaacgtataactttgtcgtcggtggggttacggaagggactacagcgttttattgaagaaagcgagtgccatctggccattagcctgcattctccctttccttcacagcgttcagagttgatgcctgccgaaagagccttctcgataaaagagatggtcgatctgttaaaaaactatgattttagtaaacaacgcagactttcgtttgaatacattgtttttaaaggcgtcaatgattcgttgatttatgccaaagagctggtaaagttacttcgtgggcttgattgccggatgaatctgattcgctttcatgccattcccggagtggatcttgaaggtgccgatatggagactatgatggcatttcgtgattatctgacgtcgcacggattgtttactacgattcgcgcttcaaggggagaagatatttttgctgcctgtggtatgttatcgactgccaagcaggaagagagtgacaagaattaatataaattatcagcttcgtagactatatgtatacggtgatttcgtagttttgtgaaaacattaaaattgatgcatatgaaaaagtacctgttttacctcagtatggctcttgtagcagtagtattgttttcttgtaaaggcggcaagaaaagtgtgtttactccaacttccagcggacgtgcttacgaaatcctggtggtcgttgataatcctgtgtgggagcgtcctgccggtagagctttgtacaatgtgcttgatacagatgtacccggacttccgcaatcggaacgttcgttcagaatcatgtctacttctgcgaacaatttcgatgctatcctgaagctggtacgtaatattattatcgtagatatacaggacatctatagtcagcctaaatttaagtatgccaaggatgtatatgcatctccccagatgattctgactattcaggctccggacgaagccacatttgaaaagtttgtgaatgaaaacaagcaagcaattatcgacttctttacccgtgccgagatgaatcgccagatttccctgttagagaaaaaccacaatgatttcatttcgaagaaggttaacagtatgttcgatagcgacatctggcttccggctgagttgggcagttcaaagactggagaggatttcttctgggcaggtacgaatacagcttccgctgatcagaattttgtgatctactcttatccgtataccgataaggatacgtttacgaaagagtttttcatccataaacgcgattctgtgatgaaagctaatattccgggagctaaagaaggtatgtatatgtcgacagactcgactacagtcgaggttcgtccaatcgatattcatggcgactatacaatggaagcacgtgggctttggcgtatgaagggtgacttcatgggtggtccgtttgtttcgcacactcgtctggacaaagctaaccatcgtattgtcactgtagaggtatttatttactcaccagataaattgaaacgtaacctgatgcgcatgttggaagcatctctgtatactttgcaacttcctactgagaagaagcaggagcagattccgatgggcatagagcaggaggagaaaactaacaaataacaaaatggaagataacaaaataaaaattggtatcactcagggagacataaacggggtaggatacgaagtaatcttgaagacttttgccgaccccgtcatgttggaactttgtacaccggtcatttacggttcgccgaaggtggctgcatatcaccgtaaatcactcgatctgcctactaacttcagtattgtcaatactgctgcagaagctgcacacaatcggttgagtgtagtcaattgtacggatgacgaagtgaaagtcgaattttcaaaacccgatccggaggccggtaaagcagctttaggggcacttgaaaaagcgatagaggagttcagggaagggttgattgatgtcattgtgacagctcctattaataagcatacaattcagtccgaaggattcgctttccccggacatactgaatatattgaagagcgtttgggagacggttcgaaatctctgatgatcctgatgaaggaggatttccgtgtggctttggtgaccggtcatattccggttcgggagatagcttcttcgataaccaaagagctgattcaggagaaacttgtcattttcaaccgttcgttgaaacaggattttggaatcggcgcacctcgcattgcagtgttggcactgaatccacatgccggagatgacgggttgctcggtacggaagaacaggagatcatttctccggctatccaggagatggccgctaaaggaatcttatgttatggtccttatccggctgacggctttatgggatcgggtaattttacccattttgacggagtgctcgctatgtatcatgatcagggactggcacctttcaaggcattggccatggatgaaggtgtgaattatacggcaggtctgcctgtgatacgcacttctccggcgcacggtacagcctatgatattgcaggaaaaggggttgcttgtgaagattcattccggcaagccatttatgtagcgattgatgtattccgtaaccgccagcgtgaaaaggcagcacatgccaatccgttgcgtaaacaatattacgaaaaaagagacgacagtgataaactgaagctcgatacagtagatgacgatatttaaccaggaagggagtttagtgcgaatatgacaaaagcggaaatacaacaagtaaaactaaggttcggtattattggtaacactgaagccttgacgcgtgcgatagatgttgccatacaggtagcgcctaccgatttgtccgtgctaataaccggagagagtggtgtcggcaaggaaagctttcctcagattattcatcagtatagccgtcgtaaacatggccagtatattgccgtgaactgtggtgctattcctgaggggaccattgattcggaactatttgggcatgaaaaaggggcttttacaggtgctattggtgagcggaaaggatattttggcgaggccgacggcgggactatctttctggatgaagtcggggagttgcctttgcctactcaggcgcgtttgcttcgtgtgcttgaaagcggagagtttataaaagtaggttcttccaaagtgcagaaaacagatgtccgtattgtggctgctaccaatgtcaatctgacacaagccattgctgaagggcgttttcgtgaggatttgtattaccgtctcaatacggtacccatccagattcctcctttgcgggaacgtggagaagacgtgctgttgctgttccgcaaatttgcaagtgattttgcggagaaatatcgtatgcctgcgatacaactgaccgaagatgccaaacaggttttattgtcatattcatggccgggtaatgtgcgccaattgaagaatatcacggaacagatctccatcattgagacaaatcgtgaaatcaatgcttctattttgcggacctatctgcctgcccagaatacacaacgactgccggctttgttcggtgtaaaagccgggaagagttttgaaagtgaacgtgaaattttatatcaggttctctttgatatgcggcaggatgtgaccgaactgaaaaagcttgtgcacgaaatcatgtccgaacgcggagctgtagcttccaatgttggtacgttttatgccccggctcctgttgtgacgcctccgccttctgtacctgccctgatccatccggtcaagcctaattgtcccgatgacgatgacatacaggataccgaagagtatgttgaagagtctctttcgctggacgaggtagagaaagaaatgatacgtaaagcccttgagaaacatcatggcaaacgaaaaagtgcggcaaaggacctcaatatctctgagcgtaccctttaccgaaaaataaaagaatatggattggaataaaaagataatgcgaatctcactactggttgtcacgctggtagtgggcatctcgtgtactgtttcttataaatttaatggtggtaatatcaattacgataaggtaaagactatttctatagccgactttcctataaagtcggactatgtttatgcaccgttaggtactaaattcaatgaagatctgaaagatatcttccttcgccagactcgcctgaagctggtgaataataatgccgaccttcagattgatggagaaatcaccggatacaaccagtataaccaagctgtttcggccgatggatactcttctgaaacgaagctgacgattacggtaaatgttcgttttgtgaataatacgaaccatgagcaggacttcgaacagcaattctcggctttccgtgtctacgactcaagggagttactgacagctgttcaggacggactgattgcggagatgaccaaagagattacagatcaaatatttaatgcaacggtagcaaattggtaattgggatgatttctgctaatttacaacaatggattcagcatcctgaaacgctgaataaagatactttgtacgagttgcggacacttgtcacacgctatccttatttccagtcgctgcgtttactctatcttaaaaatctttatctgttacacgatatctctttcggtgcggagcttcgtaaagccatattatatgtggcagatcgccggaagctgttttatctgattgaaggtgagaggtatattttgaagccccgtaaaaagaatatgccttccgaagcagaagtgttggaggaagagcccggtctgaatcgtacactctccctgatcgatgcttttttggccactgtgcctgaagaggtttccgggcagacaagtctggactattcaacggattatactacttatctgttacaggaagatgaagaagattccgctccggaacagtcggagattccgaaacttcgtgggcatgaattgatcgatggctttatcgagagaagtgagggagaaacatccattcgtctgcagcccgcagctaacaatgaaacgcttcccgtggaagaagagggggaggcgcatcatgaagaagatgaagatgatagctgttttaccgaaacattagccaaaatatatgtcaaacagcaccgatattccaaggcacttgaaattattaaaaaattaagtttgaaatatccaaaaaaaaatgcttactttgcagaccaaatcagatttttagagaaattgattattaacgctaaatcaaaataacaaaatgtacttattattagttatcttaatggttattgcagccatactgatgtgcttcattgtgttgattcagaactcaaaaggcggtggtcttgcttctgggttctcgtcatctaaccagattatgggtgtacgcaaaactacagactttctggaaaaggcaacttggggcttagctgcatttatggttgtgatgagcattgctactgcttatgttgttccgacttcttcttctaaaacgcaagatgtcatcatggaacaggctcagcaggaagaacagaccaacccgtataacctgcctgtaggtactactgcaccgaagacggatgctgctgctccggctgaagcacctgcaacagaaactccggcaaccccggcaaactaacaacagattctttttaagaaacgataagtgaagctgcaatttcaaaccgaaacttgcagcttcacttgtttttagccgtaaaatgtatctttttgttaggcatacaaggcggatttagttacctttgttcgctataacacttttactaacttctgagtttaaatattacaatgacagaacaattgagaaacaaactgagtgactccaaaacacttcgttggagtgtgctcgctctggtcgcttttactatgctttgcggctatttccttaccgacgtaatgtctcctttgaaacccatgctcgaaaaagagctcctttgggatagtttggattatggattctttaccagcgcttacgggtggtttaatgtattcctgctgatgttgatttttggtggtatcattctcgataagatgggagttcgtttcaccggaatgggagcctgtatactgatggtgctgggttgtggactgaaatattatgctatttctacaactttccccgaaggcgctttgattatgggcttcaaaactcaggtctttctggctgctttaggatatgctatctttggtgtaggtgtagagattgcaggtatcacggtttccaagattattgtaaaatggtttaagggcaaagagatggctttagccatgggacttgagatggcaaccgcgcgtatcggtactactttggcaatggtacttactgttcctattgccgattattttggctatacggatgaaagtggcagtttccataccaatattccgatgcctattttgttgtgtctgattatgctgtgcatcggtactatcgccttctttatctataccttttatgataagaaacttgatgcttctttagatgctcagggagaagaaccggaggaaccgttccgtatgaaggatgttatgcttattgttactaataagggattctggttgattgctttattgtgtgtattgttctattccgctgtcttcccctttattaaatatgcaaccgacttgatggtgcagaagtataacgtagatcctaaattggccggaaatatcccaggattactaccgatagggaccatcttcctgactccgttgtttggtactctttatgaccgtatcggtaagggagctacattgatgattatcggtgccgttatgttgattggcgtacatactttgtttgcgcttcctatccttaatgtatggtggtttgccactgtaattatgataattctgggtattgccttctcactggtgccttctgccatgtggccttctgttccgaaaattattccggagaaacaactgggtacagcctatgccctgattttctgggtacagaactggggattgatgggtgttcctttgttgatcggatgggtactgaatacttattgcaaaggtcccgttgtagatggtgcacagacctatgattatactttgcctatgtctatctttgcttgttttggtgttttggcactgattgtggctttgatgctgaaagctgaagataagaagaagggatacggattgcaggaagcgaatattaagaaataacagaatatggcagacgcgaaagagaaaataaatcttctggatgtaattcctttccgtagtgagaatattacagccgaaaagggaagcgatggtaccgttaccattgctttcccccggtttaaatatgaatggatgcggcgttttttattgcccaaaggaatgtctccggatattcatgtccggctggaagaacatggtactgccgtatgggagttaattgacgggaagcggaccgtacgccagattattgaagaacttgcagagcatttcgatcacgaagaaaattacgaatcgcgtattactgcttatatcacccagttgcagaaggacggatttgtgaaattagcagttacaaactgacggtgtttgaaaagcacaatttaagaaaataaaaaaaactccgactgacctgtatagatcagccggagtttttctatcagttttattctccttcttccctatctactttaatcaatcctcctgtagccggattgaaagtaacttgtacggtcgattttttattgaaaagagccggagccagatattcaattgttccgaactgtgtaacgggaagttcaccgttaaaccattctttttttccttctataagcgtcacttgtgccttaccgggcacgttataagctatgccgtctactttctttttgccatcgtcttccggtacattgactgttttcagatttttcagagtaatgtaaaccggttctcctgccaggtcattattggcaactatacccagtttcctggaaaagcggaaggccacttcgttatccatctctttttccggattcaggcggatagtaaatatccgctcgtctttattcagtgtacctgagaacatttcggtcatggcagcttcctgttcttccaggttggcaagcattatcttcagttgttctccgtctttaggcatgttgtctgcctgtccgcgtactaaggcgtttttgctttcgcggatgttgtagatttctttggcgaccaattcagccattttagctgtagaacctgccatcagaatctcttctgtcagaaaatcgcgtggatttactttttttctcagcgtagtggctggttgtataggtgcagacttcttcggacttaacggtacattgatcgatttaacaataccgtcttcggtcaactctatcaacggagccactgttttatccttcagtttgacgaaataggtatggtcactatcggggataccgacagatttggctttgacgctgaccagttcccaatattcctgaggctctcccgacacatcggtcagccgcagataacggtcggcatatttgctgaattctcccggagtgtatgtcactttattggctttgacttcaatgtcgattgctgttttaggaagtgcataggtcaccccgtaatcttttccccgggtaactcccgctgtaacttctgtctgggcatatgccgaggcagaaagtaacagtcctgtcagtataattagctttttcattttccggtttattttaactggtttaaaaaacaaagttaatgaagttatttggaaaatcataagttgttaacctttattcgcttaccagacgccaggccattggcagataattgacaatatctccggctgtcataccgataacgccctgctttttgcgtgcgaaatcgccggccagaccgtgtacgtaagtacctattttagctgcttcttcagccgggtatccctgtgtcagtaaagccagtacgacacccgtcaatacatctccacttccggctgtcgccatgcccggattacctgtggagttgaaataacatttgcccgaaggggtgataattgctgaataagctccttttaatataatatgtactttagcggtacgagccagttcacaagctttcatcagtcgctcgtacgaattctggcatttgcccaccatacgttccagctccttggggtgaggggtcaggatggagcctttggggagcgtggtcagtgcatggcggtggttggctaatatattcagtgcatcggcatccagcaccaaaggagtctggcatccactgagttgctcgagcaatgcggcttctgtttcttctgagcgtccgattcccggaccgatacctaccgcctgatagtcatctgtatctgtgggaaaagcaaagcaggaatcactggcatcgagtccgacaattgcttccgggacggaaatctgtaggatgtcattgttacgcatgggtgcgtgtacagtcagcaatcctacccccgaacgcatacaggcacgggccgccagcaccgaagcccctgccataccatacgatccggcaatcagcaaggcgtgtccgaaatttcctttgtgtgaaaaggggctgcggggtttgatcaaagcatgtatctcttctgcttccaataaggcataattgctttctgtttcttcgatggcttcatggctgaggttgatatccagcaatttccattcaccaacgaattcggcattctctgcgaagagaaaagccagtttgggcaattgcaggctcagtgtcagatgggcatggatgatattggcttttacgttaaatgtgttttcttctcccatcaatcccgaagggatgtcgatagcaaccactgtagcaggcgatgcattgatatatttcactacagccgcgaaaccgccgcttaacggtttattgagtcccgaaccaaaaagtccgtccactaccaaatgatccattgtcagggtaggaggtacaaattgtgtgcttacttcactgaacttcacattatccatcatttccaccaactctttgttggtctgacagtcggctgacagttctcctttcgggttgaacagataggcttcaaccttatattccttttccgccagcatgcgggccacggcaagggcatctccgccgttattacccggtcccgcaaataccgtgacaggagttgtgatgtcccaacgttcagtgatggcttttgtcagtgcctgcgctgcccgttccatcaggtcgatcgatgcaatcggttcatgttctatggtgtaagcatccagttttttgatgctgctacttggaaaaatcttcatggtgaacttttattttaagttttttgacccacaaagatagcaattaatatacgaaatcaggaacttctttttcttcttctttttttctgaatgcgcctgtttttccgtagttctctctacgataacgttgatgcagatagataaatgaacatacgaaagcgacaaaacaaatcactcctacatagccggccatcaggttgtagaaagtagtccagttaatgtcaggtgaaaagaattccttgacagccaatacgataaccgtacccgtataaccgagaaaatcattcatggcaataaagaaacctacattaccccggattttaaagcatgcgatgaatcggtcgaagaaaatggtctgaaaagtgagaaaagccagataaagacagaggctctgaatgaataaccagacaatagcgtttaattgcaattgttcgtagccaaatgaaaccactgccatcactaccatgctgatgatgatcaatcccagtaatatcgataatgctttcaagttgcttcgtacaaaaaccatcaacccgaaaatgacaaggataatgatagttactatgctgtctacctgagcaaacatccacgaagagtattgggatacatcgataatcttcaccaggaagtcttctttgatatcccttaagattgtcaatactacattggcaatgaagagcagggtgagaaatggcataaaattcttgaagatatcccaacgctgtttgccgttcagtgtctcccgtttcgatttcatggcgatatcttcggtcgtgggttgtgggagccggttcagagaataacccaatagggcgagtataggtaaagcaatacctccgatcagagccggcatccagaattcacttatgtttaaagtgtccataacaaacaagccggcggacttagctgttcccgagctgataaccatactgacacccaacaagctggcgagtatgtccgtcatgcggcgtccttctataaaactaaaaatgattccccacatacatcccaatgaaagaccgttcagaaacatagctcctatattataaggtgcaggtagtagtccgaacagtatcaacgaagcttctgccagtacaatggagatcaggatgaatttcatccggttttcccgtttcaactctgaaataagtttgatcccaatgaacttggaaagtacgtatcctaatatctgtgcgatagtgaccactactttataatccattccaaatgcctcaagtccatcgaatccggcagccgtataaggttttcttagtgcataaaccagtgagtaggagagcaatgcagcaccatctgcccaaagaatgaaaaggaaatcggaaagtttcttttgtgaattagtttttacttgttgtacattgtccataacatctgcttgttgttttctggcgcaaaaataggtccctcgtattacagacctgttactgaatatatgaatatttattattaatagatattgataatgaaagagttatgctgtaatgtttatgtaacatttatgaaatagaaacgaaattcatgctgtgcttctatcgaataaattccctacttttaggtattgcctgtttatgtggaatctgtaactttgtttgcgaaaccaaaacaaataataaatgaaaagaaaaagccttattaacagaatcttgcagaatgtccgtaaacccgaaggattctttggaagaatgatactctggggaatgaatcagggacatgcttcgttggctcattggggaatgtcttgtatggagtggcatcagggatggaacgtgcttgatataggttgcggtggtggtgccaacctggcgcaaatcctcaaatattgcccgcaaggtaaggcttttggcatagacatttcaccggaaagtgttgcttttgcacgaaaaagaaacagaaggcaacttggtacacgttgttttgtagagcaggggagtgtcgatcaacttccatattccgatcacagttttaatgtggtcaccgcttttgagaccatttacttctggagtgacttacagcatacttttactgaagtggcacgtgtcttgaagcctggcggagcatttcttatctgttgtgaaatgagtgatccgacgaatgaagtatggaccagtcgtgtcgaaggaatggtggtgtattccgatgatcagctgaagactattcttgttaatgccggttttaccaatatagccatgtaccgccgcagaaaagaggaattatgtataatagggcataagaaaatgatgcagttgtaaaggataccgatggttagcttactactgaatgtattaacaatgttaatggtaagaagagaagtttaattgcttgccgataacttattaacttcgtatttttatgaagttaatatcctatggttacgaagttaactttaacactgtgttaaagttaacttcctataatcattttattaataccctgtttgcaggaaatcagatgattatatgtttgttgtttagttcaggtagaatcatccttttacatttaaaatatgaagttgtcaatttatcaagttagcattaatacttcttgttacttaattaaatgcttgtttttatatttttctataatacatatattatagtacttcccttctttatgaagatttgaattatacttttgatttacatgggtatagccatgttttgtgaaaataatctgtgaaaagttttggagactcgaaagaaagttttacctttgcaaccgaaaatatatatgcgtgtgaatactcttttttgaatcgaatatatatttcaaataaaataattcaacgtatcagatggttctcaaatctgatgcgaatactttttctatatccaatcattaaaaaacttaatttgtaaactgttgaggatcagatttattttttgagaatttctgtttttaacaaattttcatttctactcattattcaaacttattcttacggacgcagcgttggaggcaacagataacgataaacattggtatgtcgtattgacacgaactaattcggaacgtaaagttcgggattattttcagttacaggaagtagatacttttctccctgttcaaaatcgtgtcatcgaacgtgaaggaaagcgcatcgagcgtgagcgccttctcttgccccgtatggtttttgttcacatctctcgtcaggaaatgtttgccgtacgaaataccctgaatgtatacgacttccttcgcgatcgttctaccggagctcccacttgcattcctgataggcagatggccgattttcgttatatgctcgattattcccatgatcaagttattctgaccggtgaaaccattcctcagggaactcgtgtagtagtagctaaaggtgacttgcagggcttgcgtggtgagttggtccgttacaataataaatatcacattttagtgcgtatcgatatgttcggtagcgctatggtgactattccggccagttacgtccgaaaggataaataaaaactataaatgtaaagaaaatgccattatatgtaatggcgataacaatatatgtaacgggtaataacaatatatgtaatgtcccgttacgtcattagacacaattctcttttatataagtcaaaaaccgaagaaagaatcgacgaatcataattcattcctttttaaaatgaaaaattctctgtgtaactctgtgtcctctgttgtgaaaaagcttctggagtatggtgaggacggtactcctgtctatgtgaatgaacttactgcgttaaatcaagaactccgtaatttgtgtgccgatcttcttttccggaagggggaatctcccgaagaagaagcagaaatacttgtcactttgttcaagggttacaataccatgctgtttaatgtctccgcagagaatgaacaggttattcaagagttattggatcgttcaatggctgttttagaaaaacttcctgcctctgttttgaaatgtcagttactgttggagtgctttgagcagacgggggatgaggagctaataggagaggttaagaaaaatatagagggatttatttgataatgaaaggcattgttttagcaggtggctcagggacacggttatatcctataactaaaggagtgagtaagcagttacttcccgtctttgataaacccatgatttattatcctatttctgtactgatgttggcaggtatacgggagattttgattatttctactcccgatgatttgtctggatttcaacgtttattgggtgatggatctgattttggagtgaagtttgagtatgcagaacagccttcgcctgatggtttagcacaagcattcatcataggagaaaaatttataggagatgattctgtctgtttgatcttaggtgataatatcttttatgggcaaggatttacgcgaatgttaagtgaggctgttagtattgcagaatcagaaagtaaagcaaccgtttttggctattgggtaagtgatcccgaacgctatggtgtggcagaatttgataaaaatgggaatgttttcagcatagaggaaaaacctcagaaacctaaatctaattatgccgttgtaggactatatttctatcctaataaggtagttgaggttgcaaagagtattaaaccctcttctcgcggcgagttagaaataacgactgtcaatcagaggttcttatcagacaaggaattgaaggttcaattattaggtcggggatttgcatggcttgatacaggtacacacgattccttatctgaggcaagtacttttattgaggttattgagaaacgccaaggtttaaaagttgcatgtttagaggggatcgctttaagaaagggctggatttctccggaaaagatgaaagcattggcacagccaatgcttaagaatcaatatggacaatatctgttgaaggtcatagatgaactatctataaaataacttcttcccgatgaatataataaaaacagctattgaaggacttgtgatccttgaaccacgactcttcaaagatgatcgtgggtatttctttgaatctttcaatcagagagaattcgaagaaaaagtttgtaaaacaacttttgtacaagataatgaatctaagtcaagctatggtgttattcgtggtttacattttcagaaacctccttttgctcagagcaagttagtgcgggtaattaagggggctgttcttgatgtagccgttgatattcgtaaagggtcacctacatttggaaaacatgtatcagtagagcttacagaagataaccactgtcagttctttattccacgcggctttgcacatggttttagtgtgctgagcgaagaagtgatttttcagtataagtgtgataacttttatcatccggaagcagaaggagctattgcttggaatgatccggatttacaaattggttggagaattccttatgaaagtataattctttccgagaaagataagatgcatccgttactaaaacatattatattatcgaaataatagattttgggatatctatgaaagaattagtttatgatgtacgaaaagatataattccgtggaattctcgtattaccaggcttttattttttctgaataaaataccgtatttaagaatcctttcgaaaccttggttgagaaagcaatttaatttatcaaatacagttcaatttaattcgggatttttttgtcatgctccaaaactgaaatgtggaaataatgtaggcttagctgatacttttattttagcttatgctgatgttgttattggtaataacgtatctttttcttttaggaatatgttaattacatcaacacatgatgtcaatgattttaataaaataatggcttcctcaattgttataggtaataacgtttggataacatcaaatgtgacaatactggctggtgttaaaatcggggataatacaataataggagctggtagtgttgttacacatgatattcctgcaaatgtatttgctgctgggaacccatgccgtgtaataagaaatataagatttaataagaatggataattctcgaactgcgaaaggattgaagaatgctcaagtagctttattgttctattttataaatcttattttaagttttctttctcgtaaggcatttatagaacatttaggggcagatgtacttggtttgaatacaacactaactaatatacttgtttatttaaatttagcagaacttggtattggctatgcaataagttatgcgttatataagcccttatatgaagatgataaacaagctgttaatgaaattatttctattcaaggttggctgtataaaagaattgcaataattgtgattataatgtctggagtaatattattgttttttcctttattttttgctaaaatagaaattcctatatggtatgtatatgcgactttcctggttttattatccagctctatctttagttatttttttaattacaagcagtttgtattgactgctgatcaaaaagaatataagttaattactaatgtacaaggttttaaagttataaaaactgttttgcagattgtcgtagtaatatatttttgtaatggatatgttttttggcttatacttgaattgttgatgggagttgtcactgtatttgtattgaatgcaattgtaaaaaaagagtatccttggcttcaagcttcatctaaaatagggaagagagtcaaggataaatatccatatataattcaaaaaactaaacaacttttttttcataaaatagcaaatgttgttttgaatcaaacgagtcctattattatttattcgtatactaatttaacaatggtagcagtatatggaaattacatgctaataatttctggaatttctttattgataaattctgtttttagtagtattggggctggtattggtaatttagttgctgaaggaaatcaagcaaagattatacaagtttttaatgagttgctatcttcaagaatttggattgtttcaattttatgttttggtgtttatcaaatgtctagatcatttattgtactttgggtcggtgatcgttttgtgttagatgatttctctttgttgctaatgcttttgatcgcttttatttctttgactcgtttagttgatttattcattgcggcttatgggctttatcaagatgtatgggctgctatattagaagctttattgaacttgggactctcagttttgtttggttattactgggggcttcctggaattctaggtggggtaatagttagtttggtaataattgcattattatggaagccattttttttattcaaatatgggtttaataaaaattgtttgaatttttattttgtttacttgaagtgtgtcgcttttgctctaataacattttatttttctgttagagttattgattatattggggttagtgtatgtaccaattatggctgttggatactaaattctatattgaatattcttgtttatactatgattagtttccccattttcttctttttttctgatggtactaatagatttattaaacgaattataaatatagtattttaataatatatgttatatgtaattttacgcggacgattaggtaataatctcttccaaatagctactgccgcttctctgactcaaaattttgtattttgtacaataaatgaggaccaagagaaacaagtttctctatataaagattcattttttaagaatataaaagttataagtgggattcctgatgggataccatattacaaagagccatttcatgaatttagtatgattccttatgaagaaggaaaggacctcattattgatggatattttcaatcagaaaaatactttaaaagaaatgttgtattggatctttataaaataactgatgaggtaaaaagggaaatatggaatatttgtggaaatattttagaaaggggagaaaccgtgagtgtacacgtcagaagaggtgattatttgaagttaccgcatgcgttacctttttgtggaaagtcatattatagaagtgctattcaatatatcggcatagataaagtatttctcgtttgtagtgatgatatcagttggtgtaaaaaaaactttgtgggaggaaggttttattttatagagaatactactccattattagatttatatatacaatctttatgtacccataatattataagcaatagttcttttagctggtggggagcatggcttaatgaaaatagtaataaaattgttattgctcctcaaatgtggtttggtatttctgtaaagttaggtgttagtgatctgctaccttctacgtggattagacttcctaataattattctttaggaagatattgttttgctttatataaaatgattgaggattacttattaaatattttgcgattgttatggaaaaaaaagaagaatatgtgaaaaagaaaatgactcttattgtaaatcatccgtgggatgatgtctttgagggtaaagacgtctttttagttccatgttatattggtaaggtttatcattatgatgttaagattgtttttccttcaaatcatttgcataaagcaaaaaaaataagagacgttgagctttttcctctgttgtatgttaaaaaactccgtcctttttctttcgtgtttggttttaaattaatgaagtatctgtattgtaatgctagaaaaatagatttatttatgcgttttcatgttacaatcacaactgctattatgattattgtttataagagattaaataggaatgggatagcgtatataaaattggatagtgatgggattctgaattttgaatataaaaataatctaaagagcttgtttaggaaactgttgtatagaaaaatgtttgcattagtggattttgtatcttatgaaacaaggaggggattggataatattactaagcaaacaataggaattgatattcgttcaaagctattttatatgcctaatggttttgatgaagatatgatcaaacagctagatattaacgtgaaagaatactctcataaagagaatgtaatgattacggttggacgtttggggacggatcaaaagaacacagaactatttttaaaagcagtagagaacatcgacttgaaaaattggacaatttattttattggagccattgatcctcaaaatgttacattcttaaattttgtatcaaagtttttttttaatcatccggagaaaaaaaaatctgtaatttttacgggagcaataaatgataaaaggacattatgggaatattacaatagatctaaagtatttgtattaacttctcggtgtgaaagctatggattagtattaaatgaagcaaaacgatttcgaaactttattgtttcgactaatgtaggggcttttgaggatttagttgaatctggtaaatatgggtgtgaaattcctcaagataatgcggactatttgactcatgttttagaaaaaataattcatggtcagctaaaaattgatgtatataatgatttttcgtcagactctctctcgtattgttttcaagtaaagagaatgggactaaatagttagttgttattatacttttgaaatgatttatcacatattgaattctttttgattttttcttgttttacgtatatatttataaaatgtttttggactgtatcttttatgttttttctaaaatatgtacagagaggcgttataattattttaagagagtgaagccttttcttttttctcggatagttcgtacatggtttggacatgtaagtggcaaaatttctattgttcctccattttatatacggggaggaaaatatattcgattaggttgtaattttagggcattaagcgggttgcgtttggaagcaatcgatttttataatgataattcttatcatcctagcatattaattggagataatgttgtttttaataatagttgtcatattggagctactaatagaattattattggcgatgatgtggtagtcgctagtagagtcttcataacagatcactttcatggtaatacgacgtataatgatttacagattccagtaagaaaaagactactatattctaaaggtcctgttattataggtaataatgtgtggattggagaaggggcatcaatcttaccaaatgttacaattggggataattctataatagccgcacatgctgttgttacaaaaaatattcctgctaattcaattgtagctggctgtccagcacaaatcattcgcatcataaactaagtgaatttatttgttctacttttcgtttttatatttggtattatcggatcttatttatataagttttctgaaaagaatttgttttggctttttataactgtttttgttattataataggaggtcgtaatatatctgtgcctgacacagatcaatatttggaattttatcagcaaacactttcctcttccattttagatattcctttatattcttatgaaataggatttcaattattgactaaaatattaaaattgataactaatgaatcttcttttttttattttggaataattgtttttataaattcatatttactttttaaatctttttgtcacttgaaatatatagcttaccaaaaagagtcttcttttgataaactgttttgtaaaattaatatacaagaattccttttgttatatttttcatattgggggttatattatacaggaatcgttctaagagcggggattgctatatctattttgatttatatatcaactttattgtgtgcttcttatatttctctaaaaaagtggttagcaatatttttattagcaatcgtatcttgcttttttcatattactgctcttttgggaattgttgcacttattgtcttttatatatcaaaaaaaatgacgatgaggtcgtacttattacttttcttattaatatgtgtgattttatttggaagaataagtttctggattgtagatatattagataagaatatgccgatgatcttttcattaatagaggatactaatttagctaagttacaagcatacagtaatattgatgcttctattaaagtttcatatcgttttttgttttgtttagttataggactatttcttataatgtgtaaaaggatgccagggtattattataaatatttaaatgtttatattgttggcttatttttgggagcacttttcagtgctgttgaatctttttctcgaataatggatttttttattgtatattcttttatccttatttcaatgcgcttatgtgttatagatagctttaggacgcgtttgagtataatgttttctattgtattggtgcagtttttatttgtctatagaattatcattggcttatgaatgaaaatattaataggaaagcggtatcagtcgttattgttacttttaattcggaagatttgattatggggtgtttagactctatttttaaatataatgacatttcggaggatttagaagttgtattagttgataattgcagtgtgaattatttatctatgtttagctgtgttgaaaaaaaatatggtgataaagttgtacttataactaataaggttaatggtggatacgggcagggaaacaacttaggtataaaagtttcaaaagcaccgataattttaataatgaatcccgatgttagattggttaagcctatttttaaaaaaattttgtgtttgtttgaaagacagaatcttgcaatagttggtatgcaacaatatgaatcattgttgaaaaggagccaatcttttttgatgctgagagaggacttgtataccttgtttttacatgcgatatacacaaagataaataagtttaatgaaaagtatttttgtgtgtctggagcttgctttgccattagaaagtctgtttttattaaaatcggaatgtttgatgaacacatgtttctttatggtgaggaacggatgttacaccataaaattttgaggttaggaaattatcatattgtatatgatagtacaataggatatttacatcccaaggaggaccgggaattttcctctaaaaactttttgcttggtttacagtcatttatatatacatgcaataaattaggactagacttatatagagcttgtgataagatgataaatatgtatagatttcttgaattttactcttggattagaagggacaaattaaagattaaaatttataagaaaataattaatctgataagaaataatatatagaaattgaaatggaaaagttgaagattgccgtaataggtcttggttatgttgggcttcctttggcccgattgttttcgacaaaatatgaatgtattggttttgatatgaaccagtctcgtgttgatgctttgaattccggtcatgatatgactttagaggtttctgatgaattacttcggaaagcgatagaaaatggtttcaaatgtaccagtaatattgaagaaataagaaactgcaacttttatgttgtagctgtacctactcctgttgatttggataatcgtccagatcttacgcctcttattggtgcgagtactacagtcggaaaggttatttcgaaaggggatattgttgtgtatgaatctactgtatatccgggagtaacagaggaagaatgtcttcctgtagtggaaaagatctccggtctaacgtacaatgtagatttctatgccggttattctccagaacgtataaatccgggtgataaggaacataccgttgaaaagattaagaaagtaacttccggttcaactcctgagattgctgatattgttgattctatttataattcagtgttggttaacggtactcataaagctccttctattaaagtggctgaagcttctaaaataatagagaactcccagcgagatgtgaatattgccttcatgaatgaactctcgaagattttcaatgcaatgggtatcgatactaacgatgttattgaggctgcatcttccaaatggaattttatcaagttgaagccggggctggttgggggacactgcatcagtgttgacccctattatcttattcaaaaggctcaggtttatggagtacttccacggatcatgtctgctgcaaggcgcttgaatgatggcatgggggactatgttgccaatcaagtgattaaattgatgaataaaaaaggtattcttgttaaagattcaaagattttgcttctgggttttacttttaaagaaaactgccctgatattcggaacaccaaggtgatagacatttattctaccttacatgagtatacttctgacattaccgtctatgatgcttgggctaattcggctaaagtggcacatgaatatggtatatcgatcctgactactggtcttgataatttgtttggacagtttgatactgttgtattgtgtgttggacataaagagtttcaacatatgaatattcgcgattttctccgatctgatgcgggcgttgtttatgatgttaaagcggtattgaataaaaatataatagatggcagattataattcttctatttgttgtatttttaatatagggactcactatcgcaatcccatatattcaaaaatgtcttcagagcttccctgcgatttttattttggcgatcgtctattgacaccaataaagaaaatggattatacccaattgaaccattttcgctcagaattgcataacaaatatttattttctcagttttattggcaatctaaatctgtccggttagtctttaaaccctatacttattatgtattggatggagaaccttattgtttgtcttcatgggttatccttttctgggcaaaacttttaaataagaaaacagtagcttggactcatggttggtatggcagagaaagtattgtaaagaaggttataaaaaagttgttttattctttgttttctgagttgatggtttatggcgaatatgctatttccctgatgtcaaaagaaggctttgataaatcaaagatggtttgtattgcaaactctttagattatgataatcagttgaaagtcagaagtaagttatcaccttcttctatttattctactcatttttccaacccctatcctgtattattctatatcgggcgtgtgcaaaaatcgaagaaattggaatatataatccaagctatggacatcttgaaacagaaaggatttctggtaaaccttgttgttgtcggtaaagatgtggatggggttcatcttgatagtgtggtagataaatataatcttggctctcatgtctggttatatggaccttgttatgacgagatgcgcataggagagatgttctataatgcggatgtttgtgtgtctcctgggaatgttggcttgactgctatccattctctgacttatggttgtcctgtcataacacataataattttcctttccaaggtcctgaatttgaatctataattcagggaaaaacgggggattttttccaggaaaatgatgtaaacagtttagctgataccattcagaaatggttaagtcggagtttatatagtagagatgatatccggcagtttgcctatcagacaattgatactaaatggaatttatattaccaaatggatgtcctcaaaaaagttttttcttagacaaaattaaggatgaacaattttcgaagtttagttagaaatggtattttggatattttaggaacgttttcgtgtcctcagaatggaattcatatattgaatggacatatgatatgtcgcggagcggtcagcgatcaagctaaagattatttttcttaccagttaaagcaactttctcgttatgtgcattttatacgagtggaggaggccacttctctaatcctcaatcataaaagtgtcgatgaacctttggttgcctttacatttgatgatggttttatggaatgtcattcaatgatagcacctgttttggaacagtttggggtgaatgcggctttttttatcaatcctaatttcgtagatggggatgatgtgtatattcagaattttacaaataacatagttctcactcccggtaaaactccaatgcggtggaaagagataagggatttgcatgagaggggacatattattggtgcacatacaatggatcattatatgattaatgatagtaattgggtggaattagacaagcaaataggttgttgtaaatcggtaatagaacaggaactttctactccttgtgaatattttgcttttccatacggccgtttggaacatgctaatcaatcttcgattgatattgcatgtaagtattacaaatatgtgttttctcaatcggattataaacattacttttcttttgatggtcgtgtaattaacagacgccattttgagcccttttggcccgtgaaacatatttcttattttttgagttgccataaaaaataggggactttaattagtcttttcgatcttgttctcttctatttgatcactacgatagtgaaaactctctttcaaataaatgttgttgctaactctggttccaccggccatattgcagaggagttaggacgtttggttattgcttctggctggaaaagttatattgcttacggtcgttgggcctgtcccagccaatctatgttgattcgtgttggaactaaacttgatttctttgtccatggcttgaaatctatattatttgacaggcatggttttggctcacggagagctaccttgaacttaatttcaaaaataaaggaaataaaaccggacataatccatttgcataatcttcatggttattatttaaactgtgaggttttatttgactacctatctacagctaaaatacctgttgtttggactttgcatgattgttggagtttcacgggacattgtgttcattttcagaatatcgggtgtgagaagtggaagacaggttgttttgcatgtcccaatatacgagattatcccaaagctttaggttgtgataactctcgtatgaactatatagaaaagaagagattgtttacttcggttgaacgtatgatgattgtacctgtttgcaattggctaagtgatatgttgagtaagtcatatctttctcaaataaaacggcagactattgttaacgggattgatttgaaagtgtttactccaaaaggtaatcgtgatgtgataaaaagtaatttaggtgtagggacacgatacatgattttagctgttgctacggtttgggggactacgaagggatttgatgatcttatatacctaaactctttattaccagataagagtgtaattgttgtggtggggctaaccacaaaacaaataaaaaaattgcctggtaatatgattggtatagagagaacggagaatattaatcagttggttgaaatatattctgctgcagatatttttataaacccgacatatcaagatacattacctacagtcaatattgaagcgcttgcttgtggtactcctgttataacttatgataccggaggcagtgctgacattgtagattctgatacgggaatggttttaaaacgtggggatattcatacgttattagaaaagattttagaaataagagaaagaggtaaagagtcttatataacaaaatgtcgccaaagagcattacaattttttgataagtcaaagcagttgagttactacttgtctctttatgatcaattactaaataaagaaagatagttcttctttcatagttatgaaaatatcccttgttactgtcacttttaatagtgctaaaacgcttcgtgatacgattcattctgttctttcgcagtcttatactgatatagaatatataatagtggatggtttgtctaatgatgaaaccgttgcacttattaaagaatatgaacctctatttcaaggtcgtttgaaatggataagtgagaaagataagggactctatgatgctatgaataaagggattcgaatgtctaccggggatattgtcgggattattaattcggatgatttttatcatagagaagatgttttagagaaagttgctcaatcgtttgaagttggtgaaacagaggcgatttatggagatgtacgttttgtaaaccctgataatttggataggacagttcgctattattcttctaaaaggtttgtcccatccttgtttcgattcggatttatgcctgcccatccaacattttttacatatagaaaatattttgacctgtttggctattataaaacaaattataaaatagctgctgattatgaattgcttgttcgttttttatatgtacatcggttaaaaagtaaatatttgcctttgggttttatgaaaatgagaacaggaggtgcgagtacagcttctattaagagtaatatcttattgaataaagagatagtaagggcatgtaaggagaatggaatatggacttgttatcccttgcttttattaaaatatttagtaaaagtgtttgaactgatttttataaaaaaatgaatatacttatttctggaattcatggttttataggctctaattttattggggctttgaaagataaacatactttgtatgggcttgatattgtttttcctgctaaagatggggtcgttaatactttttcttggcgagatatcgaacccacatctttcccttttcaagcccttcctcagtttgatgccattattcatcttgccggaaaggcccatgatactaaaaaccaatcggctgctcagtcttattttgatatcaataccggtttgactcaaaagatattcgatttctttttggagtcttctgccaagaaattcattttctttagttcggtgaaagctgctgccgatagcgtagtgggagacgtacttactgaagatgtgattccgaccccggttggtccttatggggagagcaagattaaggcggaagagtatataaaagagcattttatgtttccaactgcttctattgatgaggatcagtctttgcggttggggaaagataaggggaggacggctatgaataaacaggtatatatccttcgtccctgtatgattcatggccctggaaacaagggaaatttaaatttattatataacgtagtgaagaagggaatcccttggcctcttggcgattttgataatcgccgttcgtttacttcaatcgataacctttgttatgtgattgaggggcttttgaatcaggatgtacctacgggcatctaccatatgggagatgatgaagctctgtcaacgaatgaactgattggcatcatgtgtgaagcaatgggaaaaaagccgcatatctggaagatgaacaaagggcttatggaaggatgtgccggcttgggtactctgctgcatttacctttgaatacggaaagacttcgtaaactgacggagaattatgtagtaagtaacgctaagatcaaagccgctctcgggattgataaaatgcctgtgacagctaaagaggggttgatgaagaccattcgttcatttgaagaaactaaataacttatgtactatctaatcatcttagttctgctattcctggcagaacttttttatttccgtattgcggataagtgtaacattatcgataagcctaacgaacgtagttcacatacccggattacactgcgtggtggaggaatcatcttttattttggggtgttggtctattttctcacaaaccactttgaatatccatggtttatgctggctttgagtctgataacttttatcagttttatagatgacattcgttctacttcgcaaggattgcgtttagtctttcattttacggcaatggctttgatgttttatcaatggggattgtttagcttgccttggtggacaatccttgttgccctgatcatttgtactgggattattaatgcttacaactttatggatggtattaatggcataacaggcggatactcattgatcattctgatagcattggcctatataaatagggtatatgttccatttgttgaaacggactttatttatactatgctttgcgcagtattggtctttaatttttttaattttcgcaagaaagcgagatgcttcgccggtgatgttgggtcggtcggtatagcttttgtgatcctttttctgatcggaagtttaattatcaaaacagagaattttagttggctcgtattacttgttgtatatggagtagatagtgtgttgactatcattcatcgattgatgcttcacgaaaatattggtctgccgcaccggaaacacttatatcagattatggctaatgaattgagaataccgcacgtagcagtatcgttggtgtatatgattgcgcaatttgtaattatcatcgggtatttatattgccgggattatggttattggtatttattgggttgtatcatcttgctgagtggaatatatattatttttatgagcaaatattttcacttacatcttttacctaaaagataattattatatttatgataattggggatatggtcgttattaatcctttcatagttggaggatatgtctgataatcccttctataagctataacttacttttccggtttctataaactgttttaataaggatgcaattaatgcatccttatttttttacttcgtctatggtgtcttttatacacgatatatcctgaaacgagaatcaacgttagcagaagtccggagataaaaacgaatagatccgagaaaacacctaagaaaggtgaatagcagcgaccgacatggagttctaagcagaaattccataatgacatgggttgctgttgcataaaaacaggcattgccggcaatgctaaattattctctttattgcgtgctccgttgtcgtattcgaagattacctcccgcgtgattaattcgtcggtgaatccgttaacgagactgccgccgagtggtctcccgtaagttgctgccggggggtgccctgtataataatcgagaacacttcctgtagatgggttccagataaacagtccgctgaaagagccgattaaccattcgtccgggtttttcggataaaacacattaactcccataggacttactggtggggttcgttttaatttaaccggtggcagtgtaaagtcttttataagatagaaaccggttgacgaagacaataaccagacattttttgatgcgtcccatcggatactgcggagtttgtcatgccacggattgtctgaatcaagagttgttccggggatggggttcgtgttcaccagaacaaaaggtatcattaagggcggtcggagacacatacccgtaacagataacaatatggtcagtacgatcagccatgtacccaatttattgtgccagttcagtgaagttttcaaggcctttgcctgtgttttgacagggagcctttttctgtgtcttcggcgaatgaatgagggaagaaaagtatatatgattcccgttatactgagaatgattaatactactcccagaaaatcaactaccagtttgccgggtgtaccgaacaactctccgctatggaggagccagatggtacggaataaggaggttttcggtgaataactcgcgggggcttttaattctatttttttgaattgatggtaaggagatacactggtatacagattagaacgtgtgagcacgaccagagtatctccgcgttgggttatatcagagattcgttcttcatttccggatatcggatactcctgccatttgtttttgtccaggagatagacagagtataatccggcacaccaaatatcgttattggcaaggcggatgatattacttattttgcgattgtcgattccccgaaccagaccttggttgaaatcggtaaaggtgatgaaacaggagtctgtttgccagactcctgcattaccatatgccagaattttcccatcaggaaggcgtaatgttccttttataattccattattccagtttctgtagtgatagctttccggcatccagtttctgttgacttcaacttttgagaaaattgtacggtgattgagtacaatgcctgagaaacagaacatcaggataaagaagctaaagaacaaacctacccatttatggtatttcttccagaaatttttcattagagattgttacttagtttaaattggtactgccattcggctgaatggcgtattcaaaggaataaatgccactattgccttcgtcatcataaaaacttttggcttttagttttgcatatttcccactggctgtgcggacgataaatacataatcacttggcgtgtaagtgggaggggggccggcaaaagtgattgctttacaaagtacttcgttggcagtagactccatggtaggaggaggaaatccggtgccgggagcggtaatggtataggctgcatcgacagtgaatgttccttgaggaactgtcgtacaggctgccatatctttgatattcgtgagtaaagcaccgccttttcccttaccggacgcgccgctgttggtacgcacattgtaacggttgaatgcgatatcccaatctgtgttttcggcatgggcttcttcactgatgtttacttcttttcctttttcaagtgaataataaatccagtcgttcccatatgctgttttccggctcaggcttacctgttttaccggtaaagcacctcccccctgtgagggatcgtcgggcagagaaccgttattgtcacctgagcaggaggtgctgataaatgctgatagtacgccaaagaatagaatggcgaatctgaatttgcttttgttgttcatacttgttttagtttaatttatttatagtgtataattacatgcgataaaataatttcttcccggtgaggtagaggtattgaaggttacccggtctgaggtataatcgaacaggttggttattcctgccgtgattctcaggttctgcatgatgtattgtgacaccgtcagatcccaaagacaataggggttcaccttagcctgatagtaggcttctactttctttccctctatttcgagttcgtccaatacgtcgaatctcttttttcccatgatattgccggacagattgacaactgtggcataacgggggatacgtgtattgtattcggcacggatgttgccggaatgtggactggaagaacttaaccggactccgtcagcgtctttgcttgtgtagaggtaattgtaagctccgtgtacattgatgtgtctgtttatctgtaccttgcacatggtttcaactcctgccagatgacttttccccacattggtataatggagttcggtttggtcattactccacattccttctattttgtttcggaaccagttactgtagatgttggtattgatattgatccaactattcacgtactctcctgaaagtgatatataattgttggtttcaggtttcagtttactgttgccatatatccagaacatccccaggtgatcccaattcatatagagttctttaatgctgggtgaacggtatccgcgtgcataattgaagcggactgtgaatgggaatactttatacatgacagaagctttgggagtgacgttggcaccatatttttcatgatagtcacatcgcagtcccgccacaacggagaattgcttgttgatactccaatcgtcctggaggaaagcggtagcataccattggcttttgttctcttttacaccggtttcgaatttatcactgaacaatgactctctgtaaaattccaaaccgcccgtgatggtctgtttgtccaatgcagtggtagtgtaaacgacgcgtggctgaataatattgtttttatattcaaggcggcgcccgcttttcaattcgtatttatcataacgattgtaatggtcggtatgaatagaagcaaccagagccgatttatcggaaatcgtatagtctattgtgcccccataagtatagtcttctgatttttcgaaaatgttatctgcttgaaaatcatacttgtttagcatataatagcttccctttaactggaccttcagtcgtttactgaaacgataatccattttatgggttacttgcacgtcttcgtatcccgatatgctggtgggagttgtgttgagttcttcggtaattgtggtgttataggccgggaagaattttaccaacggctttttgtcatataattgatatccgtcgaaacttttataaagtatatcggtgttcatcgtgaattttcctaagtttaatccaagggataaattggtgttcagattgggtttatctaaatgggtccggtacttgtattgtgaatggtccttgggggtatctttataattttgctggtttttttccgcataacgtatccctgcggaggcttcaaacttcttttgggctttacgggtaatgatattgatgactccacccatagcttgtgagccgtaaagggcagaagaggcccctttgactatttcgatatggtcgatgttataaagattgattcgtgaatagtcaatgttgccaccgttttctcctgctatgcgttcaccgtctatcaggaaaaggatatgtttggagcccaagccctgtatgtcgatactggttccataaccgacttcctgaaaattgagtccgggtacttcctgggtcaagagatcctggatgttaccggttcccctttcttctatttgttttgcggtgattacctgagtgataaccggtgtgttttttatttttttttcagttcgggtggctgtaaccacaatttgttcaaggttgaaaggatcatcattcatataagaaactgtgtccttttcttgccgtacattctgtgctgctaaagggagtgcacctataaaagtcagtagtaatgcaaattttgttcttatcataatctttgtttttggatcagcaaagatatagggtacttaaagagtgtgaaatacctaaaaataggtaaaagacagatgacgattaatactaattccatcgaaataatcagttcagcttccggatggcttttctcacctcgcatatcggagggattctgccgcttctcttaaagaatttgcaggagatggtgtaaggagtggaataaaaatcgtatttttgcaaccaacttttttaaaataaccggttatgaataccattcagataaaagataaactattcactgtttctatcaaggaacaagagattcaaaaagaagtgattcgcgtggcgaatgaaattaatcgtgacctggcaggtaagaaccctttgttcctcagtgtgttgaatggttcgttcatgtttactgccgatttgctgaaacatataacgattccctgcgaaatttcatttgtaaagttagcctcttatcagggagtatcgtctaccggtactattaaagaagtgatcggtatcaatgaagatatagcgggacgtactgttgttatcgtagaagatattgtagatacgggactgactatgcagcgtttgctggaaacactgggaacgcgcgggccacaggaaatccacattgcttcgttgctggtaaagccggataagcttaaggtggatctgaatattgaatatgtcgcaatgaatattcccaatgatttcattgtaggatacggactcgattacgacggtttcgggcgtaattatccggatatttatacagttatagactaacataaaataaataataggtataccagtaatggtaaaatgtagaattataaattaacaagatgctgaacattgtaattttcggtgctcccggttcaggaaagggaacacaaagcgaacgtattgtagagaaatacggaattaaccacatttcaacaggagatgtattgcgtgcagaaattaaaaacggcacagagctgggtaaaacagctaaaggctacattgatcagggacagttgattccggatgaattgatggtagacattctggcaagcgtattcgatagctttaaggatagtaaaggggttatttttgatggtttcccaagaactattccgcaagctgaggcgttgaaagtgatgttgaaagaacgtggacaggatatctctgtgatgctggatctggatgttccggaagaagagttgatgactcgtctgattaagcgtggtcaggaatcaggtcgggctgatgataatgaagagactatcaaaaagcgtctggttgtatataatacacagacttcaccgttgaaagaatattataaaggcgaaggcaaataccagcatatcaatggtcttggcaccatggaaggtatcttcgaagatatttgtaaagcggtagatacattataattatatatgtgccgatgtgctcattaagaagatagcatggattatgggtatgtcggcacatgatcacattgaaaatttattgattatggctgaatcgaattttgttgattacgtaaagatatactgccgctcgggtaagggtggaagaggctctacgcacatgaggcgagaaaaatatactcctaacggtggtcccgatggaggagatggtggtagaggaggccatgttatcctgcgtggtaaccggaactactggacattgcttcacctgaggtatgaccgtcatgctatggccggtcatggagaatcggggagcaagaaccgcagttttggtaaagacggcgcagataagattattgaagtcccctgtggtacggtagtttacaatgccgaaacgggagaatatgtatgtgatgttacggaacatggacaggaagtcattctcctgaagggtggccgaggcggattgggaaactggcatttcaagacagctacccgtcaggctccccgttttgcccagccgggtgaaccgatgcaagaaatgacagtgatccttgaattgaagctgttggcagatgtaggtctggttggttttccgaatgccggaaagtctacgttattgtcggctatttctgcggcaaaacccaaaatagctgattatccgtttactactttggagcctaacctgggtattgtgtcttaccgtgacggacagtcgttcgtgatggcagatattccgggaattatcgagggagccagtgagggtaaagggcttggattacgattcttacgtcacattgaacgcaactctttattactgtttatgataccggcagatagtgacgatatccgtaaagattatgaagtgctgctaaacgagctgaaaacgtttaatccggaaatgctggataagcaacgggtactcgcagtcaccaaaagtgatatgctcgatcaggagttgatggatgaaatagagccgacattgcctgagggaatccctcatgtgttcatttcgtccgtatccggtctgggtatctcagtattgaaggatattctgtggacggaactgaataaagagagcaataaaatagaggctattgtgcatcgtccgaaggatgtcagcagactgcaacaggaactcaaagacatgggagaggatgaagaactcgactatgagtatgaggacgatagtgatgaagatgatctggattacgaatacgaagaagaagattgggaagataaatgatttcactcaccgacgataagaaaatgttggggtatgggctgttgggcgcataccccaacatttctcattttgtgacgacccgacatggaggttatagtgagggagcgtatgcttcttttaattgttctccttactcgggggatgaatttgaaaaagtaaaaaagaatcagcttttattgtttcaatcgctaccgcaagtaccgaaacatctgatcctccctttccagacgcatggaacaaaagtgcttctgattaataaggattttctggagacttctatagaatgtcaacaggaaatgctggacgggatagatgcattgattaccagtgaaccgggttgttgtatcggtatttcaacggcagattgtattccggtactgctatatgataaagtacatgggggtgtagcagccgtacatgccggatggcggggaactgtggggtatatcgtgggacacacgcttgagaaaatgcgggcggcatttggtacggagggacgggatgtgattgcatgtatcggcccgggtatttctattcaatcattcgaagtaggggacgaagtttatgaagcttttcgtttgaatggttttgatatgtcgcgtatctctttccgacattcggttacccataagtaccatattgacttatgggaggcaaaccggcagcaactattagactttggtgtgccgggagttcagattgaagtagcggatatctgtacttacatccattatgaagatttcttttcagcgagaagattaggcataaagtccggacgtattctatcgggtattatgataaactgctgatggacaaaattttgatttattatgtataccattactatatcgaaagagttaaaagaagcatgtcctgtttttgcaggagctgctgtatatgctgaagtgaaaaacacttcttattgtgaagggctttgggaggagattcaatcttttacagaaaagctcactgcaacaacccagttggaagatattaaaaaacaaccagtgatagctgccacacgtgaggcttacaaacggtgtggaaaagaccccggaagatatcgcccatcggccgaagcattacgtcgcaggctgatgcggggaattgccttgtatcagattgatactctggtcgatttgatcaatctggtttctcttcggaccgggcattcgataggtggttttgatgcggataagatagcgggcaccaatctggagctggggataggcaaaaaagaagagcctttcgaaggtattggccgtggagtactgaacatagagggacttccggtataccgcgatgccgtgggaggaataggaacacctaccagtgataatgagcggacaaagatggatctggaaacgactcatatattagccatcgttaatggttataatgggaaggaaggattgcaggaggctgccgggatgatacagactttattgcgaagatatgcaggatcggacggaggaacgatcacctattttgaataacaagcgtccatgaagaacatacacacttttttgattttatctctgttttcgttatgtacgagtgcacaacgcagtgcacaaaccaaattctcggatatggaggttaatcatgtccgggtggctacaccgggactttttgctaaagagaattgcatcatactcgatctgaattccctgtcgcggaattactcttttcctttgccgggaggtaaagtcatttccggttatggaacccgtggcggacatagtggggatgatataaaaacttgtgcccgtgatacgattcgcgctgcttttgacggagtggtacgtatggcaaaaccttatggtgcatacggcaatgtgattgtgattcgccatcccaatgggttggaaacggtgtacagtcataatgtgaagaatctggtaaaaagcggagatgctgtgaaagcgggaaaagctattgccctgaccggacgtaccgggcgggctactacggaacatctgcatttcgaaacgcggattaacgggcaacattttaatcccggtcttatttttgatatggataaacgcactttgcgcaaggattatctgcaatgtacgaagaaggggaaagggattattgtgaaagctttgaaaagcgaaaaagttccccctaagtataaaactctttcgcctttcctttatgaactgcccggtattaaaaaaccggaatggaatataccaggcctagcgaaatccgctgtgtattcgggtctatagcttctaaacggcgggcagctttcaggagttcgttccgtttgtactgataatggaggaagatcaatagttcgctgtttcgcatcggatagtattctacgcaggcttgcccgcaccaggtacgacgataggtgcctttctcaaagattccgtttgttttataaatcttaccggtttcgtagatacctttcaagtatacattccaattgggatggagacggtagtccacattggcaatggtagtgaagtattcggtatattgggccgtttgtggattctccaggtcagtgtggggtaaggcactgataatgcctttgttgtcgatcccctgtcgggagtacatcaaatctacataagcgatccatggccctttttcatagacgtttccggcagtgagatacaggatgtttcttcctttggcctgctgtccccatgaagcggcatatcttaactggatggctttatccagatagtaactgttccagttgatagttgagatcaggggaactttggtagcttctacatttgccggtagcccgtggagataggtatcttcatccccaccattacggttgtttactatctggaagttcaattcctgagtaggggttacattccaggtggcagatacacctgccagaaagcagttgacataattattaaactcactgaactcacgcactttaatcgggttgacatagtattcgtagccacccagcatgaggaactgttttccggcggtgatggaaaagcgttcggagaggtgataggtcagataagcatactctacggaagaagacaggttgtccagtacaaagggattgctgtatttattaaaagattgacggaaatggtaagagaacttttggttgatatttcctacaatttctaatttgaaccgattaagtttgaaagcgacctcctctaattcattctcggtaaaagaagcagcacatgaggtgtagagttgcaggttcatgtgagcggagaatcctttgttttcttttccggtgatgcgttggactacagaagaaatagagtcgtttggggaaataatgggttgctgttgggccgtaatggtacccatggtaaacaaggttaccaaaaggaagacgtgtcttttcatatttgtgaaatctctttgggttaataaaagtgatgcaaaaataataaaaaacgtcttccttttcgtcttttcaaggtaaaactgtctgtttctccttaaagttcctgttctgttagtctacaaattttaggcaaacaggtttgtctacttttatatctttcttgatgtcggtcaatagtccggtagtctggttcctttcaaatatctgaatggtattggtgtcgcggcacgctaccagcaaatatttgccgttgggggtaatgatgaagttacgcggatggattcccgttaactgataacctaccttggtcagggtaccattggtcttgtcgactttgaagatggcaattccgtctgctttcaggcggttgctggcatagagatattttccgtccggactgatgtggatatcgccactgccttgcgcatttacagtatcggctgcaatggtttgaatttcatccagcattccgtcggtataccggaaagctattaccgtccctcctatttcgttaataaggtaagcaaacttgctgtccggactgaatatcagatgtcggggaccggaacccggagcaaccttaaaagcttccggattaccctttgtcaggagcttctctttgttatcggcattggcattcggattgagattgaatttatgtatctgatcggtacctaagtcatcggcgagtaaatatttgccatccggagtgatacgtacgcagtgcagatgaggcattgtctgtcgttctttatccggtccggaacctttaaattcgattacatcggaggcgggtagcagagaaccgtcttttccgatgggaaagacagtgatactccctccgctatagttggcagtgataacattctttccgttggtgatcaggtagcacggatcggcccccattgttttctgagtattcaataagcgaagcgttcctttggttttatcgaaagcaaaggcgctcacagatgcctggtctttgctaaattcattgacggaataaacgaattttccgtcgtccgacggaacgaggtatgatgggttagcaacttctgcatcactgagtggtaccgattctccggtttcttcgttgaaccggaaagtgtaaatgcctttactgtcgccggaagtatatgttcctaccagcatagtcagttcgttgtcagttgttgttggatctgccggctgtgcggttgtcttctttggagaacaactggctacaagcatgccgactgcacagatactaatgattttttcgaccataataaatagatgttattttgagggtttgttggttaccttcgttatattctgaaaacacaaagttagtataatctcctgtgtttctttccggaatgaataaaatatctaaaatccatcctctttttctttctttatgatgaatattccctatctttgcagccacataagtggttaccacttcctcatctcaaaaggggttgactggttttgacagcgggcagaaatggtgggtaagcatgcagtgcgtcggtgatttgcactttaatctcagttatcaaaattttatctggcgaaactaattacgctcttgctgcttaatcgaatcatagtagattagcttaatccaggcaccaggtgccaggacgagacatcactcggaagctgttgctccgaagcattccggttcagtggtgcagttacatcggggatagtcagaagtggcctcgcgcttcggatgaaaatttagaggataaggcaggaattgatggctttggttctgctcctgcacgaaaaacttaggcaaagataagcatgtagaaagcttatgatttcctcgtttggacgagggttcgaatccctccagctccactttatgacagaaacgtccctctgaaccggtaagttcagggggattttttgttaagaatatccggattgtccgggttatttgttacgttctcaacgtaagtcgttgataggtagctgcctatcggcatttaaactgctgttatttgtccgggtactttattttgtcttttaaaataaacactctacatttgacttctgagcaattcgtcatagagagtcgacaagtgagaaacggtctaatcccaagtatggttaaagaaattattgtctgctcatatttattgtttattcatattccggtaaatgcccttgccaatctatctttttcttaataaaaaccatattggggaaacaaactgaatattgtctcgttataatgtagatcagattgatttttcatgtgagtcgcctttcttgatgtcctgttgctcaccgataaacgatgtgaacatctcattactattgttttgttagtatcctctacgacaacagggagggatttaaggcgttcaggagcgccacaaatccggtcacctactcacgtgatgtgcagaaggtagtgtttttctttcccccatgactaccttactatagggttcccacttttaataaaactactccattttaattataacaaacaaaaagaatgaaatatattttatacttcatgatgatgatatatggttcgttatgccatgccatcgtttgcaaacacattgtagaaataagtgaaacgaatactcgtaaagtgcatcagatacggagagatgccttgggatatatgtggtttatgagccataccggaataagccggtttgatggaacgaagctgaaacactataagttgtctgccgaaggacagactgtggattattatatgggctgttgccggctgcttacggacaaagagaatgggttatgggcggttacccgaaacggagatttatggacgtataatccgtcattggataagtttgagtgcagaaaccatctgccgaaccaggataaggcgtcagtgcgctttctctgtgcagatagtcaggggcatatctggttttccgctggaaaccggttgattgcttatcggggaattactaatactttctatcgggtgaatcacaatctgaaacagatttccggtatggtagaagtagctccgggagagtatttcgtgggctcggatgaaggcctgtttgagataaccatgaagggttattccatagaaaaacaatccggcgaactgtccgggaagagatgtcgccggatacatgaaatgctttttcatccgtatagcggcagactgattatcgcagactattcggaagggttaatggtgtgggacacgaagtcggagcggatgatttatacatgggacaggcctgtgaacagccggattagcagtttgcgaacattggacgaccggaatgtcttagtagcaacggacggtgagggattatatcgcatggacattattaacccggaaatcaggtcttttgtacataccgattttgagaatggtaattcaattcgtacgaaccggattgtcgatttgtttgtggatgatcagaaacatatctgggtggcggattatccggaaggcgtatcaatgattgatatggattctccggatgattataagtggtataggtttcaggcaggaaatacgcattcattggcgaacaaccgggtaaatgcggtattacatgattcggacggggatgtctggtttgcgacggatcgtggtatcagttgttttcacccgtcgacaggcagatgggaacggattgttacagatcttccttgccagatgtatactgcacttagcgaaacaggtcccggagagatatgtgccggaaactatgtacacggcttgtacatcatccgtaagaagaataataatcaggttgttccgtatgcccgcatttccggggtcaatgcactttgccgtaaggataaagatcggttgtggattgggacggatgaaggtttgtttctctattgtcccaatgataatggtgttgtagaagtgaaatccttgtccggtctgcacattcatgccttgtatcagtccgatagcaattgcctgtatattggaaccgaaggaaacggtttgctggtctaccgtccggagcaatcccggctggatactgtgaaaaattcaggagttactaatgtgtacgctgtttgggaggatgacaagaagcggctgataggaagcagtgatcagtttgccttttcatttgatcctgtacagcattcgtttcggcggtttcccaataaaggactccggattacgtcgggagcttttattggagacggcaggcagatactgggtacataccagggagcaattgattatgacaaacaagagcctcgttcgttacacaagacctgcctgggattttatctggacgggcttcgggtgctggataaggatatgaccgtagaaacagaaaatactccgttagaaaaagcactgaattatacagctaccttacagttggatcatgatgaaaacactttttcgtttacggctactgccgtccgctacgatgaaatacaggatatagcttacagctggaaactggataatacggactggagtaatccgtcgccggagaatagaattcgtttttcgaaccttgctccgggtgaatatgtcttctccgtacgggcaatatccattggcaacggacgtccgtttgcacagaggaatatgaatatcgtgattcgtaaaccgctctggaagacaaatggcgcttttctttgttatggagttttggctattacgctggggtctttagctgttcgttcatggttcatctggcaagacaggaatctttcaagagaaaagatacaattgtttatgaatactacccgtaacctctgcatgccgcttacgttgataaaggttccgttggagtatctttatgaaaaatcgtcttccgaacttgtcaataacgtattgcaacagattaagggtgtaaacaatctgctggccgacctggaaagcatcagccgtatttcggcttctcccgggtgcctgtctcttgccgatcatgagttatccatgtttctcaaagagacggtgaaccggttcagtgattacgcaaacgaaaaatgtattacgcttcgttgggtggacgagccggcttttgttaccgtgtgtctggatagggagaagatggctgcaatcctccggaaccttttgatggcttttaccgacagtatagaccggggcggggaaatacttctgagtacatcgtgcaacactcaaaactgggagttgaggctggagtctgaagataacggacttcttaaaaaaaaattctaaattataagggactggtttcgggaggctctgccgagaccatgagttggttatttatacgcaaattaatctgtttgcataaaggcaaaatcaaatttacttataaagaagagcataaactggttcttatcttagtctttcctgttgctatccggcaatcggagaaattttctgacctttccgatctgctttccgtacctgaatttccgaccaaggacagcgaactgttaccggctaacgaaacgttgccggcaatggaaactccattaccgaaacatcgggagaagagacgcaacggacgttctttggtattggtcgaaacccataaagaattacgtaattatcttgtgcgaatcctgatgccggattacgaagttgtatcggtttgcgatgcggaaacggcctttacgactatatgtgaacggcatcccgatgctgttctggcctcttcagcccttgtcggaatttcgggggaagaacttgctgtccggattaaatcggatgacagggtagcacatgtacctgtgatattgctggtgaaaccgggcgaagacagcaaggagacccaacggaacgccgatctatatgtgacaatgccttttgccatttcgttcttaaaagcagagattgaaagtctgattactaaccgggagattatccgcaagaggtatatccgtttgacattaggggttgatgctccggatgacgtcgaagccgatgtgccgttgtcggatggtgatcaggaatttatcagtctggtgagaagcctgattgaagagagactcaccgattccaggtttacgattgacgaactgagtgattgtgtgaatatgagccgttcgagcttttacaataggattaaggagataaccggccatgcacccgcagactatgttcgtagtgtacgccttaacaaggcgctgatcttgctgatgagtaggaaatatactgtagccgaggttgccgacatgacgggattcagtgatccgaaatatttcaggatcgtgtttaagaaacgtttcggagattcaccgacaaagtatataagcaatttgtaagttaacgggagaccggccgggggagtgccttgccggtcttcattttattaactaatcctgtcagtgggattgaaagaataactcttatctttgcttctcaaaatgtgaactgcgatgtagaattattgcagaaatgggcgaacgtaagattatacatattgatatggatgctttctatgcttccgtagagcagagagaccatccggaattgcgtggtaaaccgcttgctgtcgggcatgccgaggagcggggagtagtggcggcggcaagctatgaagcgcgtcggtacggagtgcgttcggctatgtcgtcacagaaggcaaagcgcttatgtccgcaactgattttcgttcccggacggatggacatatataaatcggtttcccgccgggtacacgagatctttcatgaatacaccgatttgattgaacccctttcgttggacgaggcattcctggatgtgacagagaataaacagggaattttactggcggtagatatagccagggctatcaagcagcgcatccgtgaagagttgaacctggtagcatcggcgggtgtatcttataataaattcctggcaaagattgcttcggattttcgcaagcccgacggactctgtaccatccatcccgatcaggcgctcgatttcattgcccgtctgcccatcgagtcattttggggagtaggaccggtgactgcccggaagatgcatttgctgggtattcacaatggccttcagctacgtggctgttcgtcggaaatgttggtacggcagtttggtaaagtaggattgctctattacgattttgcacgaggaatcgatctccgtcccgtagaagcggtatggatacgtaaatcaatcggttgcgaacatacgttggagaaagatattcatgtgaaatcggctgtgattatagaactttatcacgtagctacggaacttgtggaacggttgcaacggaaggacttccggggaaagacgctgacgctgaaaatcaaatttcatgactttagccagatcacacggagcatgacgcaggctcaggaactgacgagccttgaaagaattctgcctcttgccaaacagttgctgaaagaggtggagtatgagcaacatcccattcggttgatagggctttcggtgtcgaatccgagagaggagacagatgagcatcggggagtgtgggaacaattgagttttgagttcagtgactggggaaaatagttaaagatcgggatgcggggatgaaatagtcgggtgattgtatctgtttagtattatttttcttatctttgggagtgatacggcattgagaactaataaattataaaagatcatgaacctgagcagatgtccaattctcttgttgctactatttgcgttgttctgtagttgccacgatgaagacagggaggatatacctccgaccgacgaacgaaccgcgaacttcattgtgaaatataacgacggatccggaatacatccggattataatgctaaagtatatatttattatggaatatattcgatggatattgcaggtttccgctatcttccggatggagttctggaatatcgcggacaggaaatagttcctgatatagaattgtctgctgatgggaaagaagatgtgtcactgttattaaataacacggagaaggtaacggtcgtggttgagagttccttctatgaagggaaaataggaataacaagttactctccgggggatatgcccataaagggtacatttatattttggggatagtatggtggctcgggacagtcgcctgaaggtctgtcctcgttttatgatctatacagaaggggagaagccgaaacttctccccttctgtatagaggctctgtttgctatgaacagagcctttgtttggtacggatagagcctctgttctgcttctgcagagtttctgtttccggcaagtgcttacttcattcgttttcggagcaaccggctcccggtgcttttcccggttgcatccgggggaattgccggtttctccggaaaagcccttaaagctgccggaatctgtttgctacaatccgtgtatcactttcatcagttgttcgcccagtccgatggtataaccttgtgaaacaaaaactacccggttgaacgtatcaccgataataaacatcggcaagatggtgctgttaggcaatttcattgattcggcaatttgtttctggatggctccgttcacatcgataccataggtaatggttgagggcagtccggggaattctgtcgggcggaacttcttatattgttcttcattagggaaaagcagtaccattttgcggccccatttttcgaattcgctgcttagagccgcaatatcccggagagcatggtttgtcggttcttgtccggctcccaacacggcaactacaaaatatccccgtccgcaagtctgaagaatgctttgcggttcggtggctcctatcggcaggtaggtggattcggagttgaaattaccgatcacctgcacctgatccttactttcgcgcatcaccagatcgacagttgttgtctttccctcttcgatggtgaagaaagtgatgttggccaacactgctccacttgccatacgggttccggttaccatcatgtagtatccggtatccatgcgggcgccatttttcagcaagttcgaccaggtggctccgccgcccatatctacgtccccttcatcgtagttcagcaattggaaagtcccgttgcggaatttcgagagagtgaagtgtgaatagtatttcggatcgctcaacgaagggataggctggtagcgggctacgagtgttccggtcggtgcctgtgtctgctgtgctgcttcaaaatccacgtcgtagactttaccgttctttagatcgttgtcattgaaactccggtattgaatttttccggtcacttcgtctatccaggcggggatacccagactacgtgccatggatacaaagaaaatgttacgggacttttcgtctgctacccgggctttccatactcccattggagacatcggaatacgttgtgagttcagttcattgttgatagtgatctcttttctgcaccattctaccaaagcctgtggattctttcggaaagcttccgcttcagttgccgggagctctttctggaagaatgctttgtagggagtgatcatttcgttggccacacgagggttcagtacgttgctgtagaagtcctcggaaccgggcagaccggagttgttcaaatgatcgttcagtacttccggactaacgtctctcaggtccttggctgagattactttcagcaggctgatggcctgaccggctttatcggcttttacggcagcagaaaggaaatttgtcagagtctgatggttacctctggaagctatcagtaggcgcactgtttcggtttcatccagcttgttctctttggcaaaagtccgggcttgctcttcggtaatgaaagtggctacgtaagcattgcggatggaatcttcctgtgccatgcggcggtcgttttcagcacgttgctccggagtcacttcgggcaggttggcaccttcggccggaggaacaatatccagtgggagtgaataggtttcaccggcgttcttgtccagtgcgatcttcagttcgttatctttgccgaatgacaatttggaataaccgaaccgtccgtctttagaggcccataccagcatatcgcccttgccggcagtcagcgatgcgcgtcctgccttatccgtatgtttagtggctacggtgtagaattcagcataattatacaccttgaactctacagtggcatcggataccggctgcccttcggcatctgtcaccaataccgagcctttggctgtcggagcatagttgtcgattacattgatttccgtatagttcggagtttcgtacatgatttcctcttgtccggcatagcgtccgaatactttggtatgcatcagcatgccacggctggcaggagcattaaaccagcccaggttcagtaccggttccggttcgcaggcgccgaagaaataccatttaccatctacccaggcttctacccaggcatggttatcgtcggtatgcgcccaacgcggagtataaacctgccgtgccggaatgcctaccgagcggagagcggctacagtgaaggtcgattcttcaccacaacggccataggcggtctttaccgaagcgaggggggaactggtacgggcatcgcttggggtgtagactaccttttcgtggcaccagtggtttacttcaagcacagcgtcgtgcagcgacaggttcttcacacgatctttcagttcattgtaaaatacccggcgcgagtcgtccagattttcgttgtttacccggatagggagtacgaaatggcggaatacgtcatcggggatctcttttccccaaggcatttcgcgacgcgcctgatcggagagtctgacattctccagatagtagtcacctgtataatccgtcacgtcacctgtgggcatataggcatagaggaacatcaaggcctcctgttcgggagtggtgagtttttcattaaacactgcgaacagatctccgttagggagctgttgcttcttcttttcaaaatcttgcgtcacttggctacggtaagtctcatctttcaggaagtgggactcactgcatgaaaaaaacgcaaccgacaacatcgggatgattagaaagcgggtcagggttttcatacaatttgttgttaaataaggcttcgctccttttttctctcccggagagaggggaggagtgaatgctgttggtttatatatttgattatgatttctttttttatttcctaaaatccgttcattgggaagagtactgtggggatcagcaataccattcccagaatgatgaataaaagaagtaccttccagaaccatttcacccatatctcgtaggggatgcgggcaatgcccaaggctcccatcaatacggcggaagtaggtgtgatcatgttggtaaatccgtcaccaaactgataagccattactgtagcttgccgcgaaagcccgatgacatcggaaaaaggtgccatgataggcatggttaatgcagctttggccgatccggacgggataatcaggttgatcagtgtctgtatcaggtacatcacccccaaagatactatttttccggtttctcccatcagtgaagccagagaatgtaagatcgggtcgatgatatgtccgttttgcagtatttggatgatccctcctgccagacctaccacgatggcagctgatagcatatctttggctccgtccatgaattgcctgatgatgttatctgttttttcactgttggcaaatcccgagagaatacccattgcgaggaagatggcggagatctccggcagataccagccatgtcccatgacaccggtaatcaggaaaagaatggtgaacgcaagcagggtcagtatgaagaactgattggatttacgtaaacccagccagccgaaggcggcaaacaaaacagacaggacgggcactgcatagcaggtgacagacgcttcgcctattgcgaaagtactggttgggtaaatgatggaaaacaggcacaaggatatgagtaacagtatgtagacgatccatgccggacgagtcgtgacacgggatatctctccgttgctttcttcttcccgtttccgccaataagcatcggcatgatacatgggcgatttctccggatgctttttaatgacggcggcatatctgagtacacagactatcaggaccgtggtcagtatcagccagcaaagcatgcgatattcaaatccggaaaataacggtaagtcggacaagccttgtgcaatgccaatggtaaatgggttcagtacggcacccgaaaaacctatgtgggcagcaacatataccatgcaaagccccgtgatggaatcatatcccatcgaaatggccaacgggacgatgataatgacaaaggccagggtttcttcactcatgccaaatacggagccgaagaggctgaagagaataatgactaaggaaatcaccacattgtttacccccaatgatttaatcagtctgtgcttttcaagcccctttgtaaagttcaggaatgaaaagatgccggtatcgatggcacggctgctgttcattatctgaaaggcacctcccatgatcaataagaaggcgatgattcccgcttgccgttcgaagccttcaagaagagcgctgaacacttgccaggtctgtggcgtctgttctacccggtggaaagagtggtctataatgactgtgcgggaagtgccgttgacgtcaatggtctcgcgcacatattcacctgcgggaatgatccaggaaagcactgcacagagcaagatgacagaagaaatgatggtgtatgtgtgtggtatccgttttagcatagtcgtttttcttgataaagcgcaaagttatgcaatatatttgtaatatgcacttgccaaatctgcccatataaaaagaaaaatcaactaataacacgcttttcttatgttttagaacatgttttcgaaaacatttcgtatctttgcagtgttaataaagaaaacaagatgtaaaaccgctcttcaaaacgtggggagcaaaaaaagaggaccaaaattatgaaaaagaatgcaaatgaaattatgatgttgcagtaccgtatcaaacgttaccaagcaatgggaaatggaacaatgtgccagctgttgaatggcaaacttcaaaaactgcttgcaaagcaggttaccatgtaattaaacacacctatattatatgaataagaagcggggaatcggatgattctccgctttttttgtcatttatctgtctgtaccgggaacaatcattataaaatattcgttaattaaacaacgaatcctgttttatctcaaatttattactacgtttgcggtcactatgataaagtacgtattctgcatattgataggtatcttcttaatgtatggagccggttgcacagcccctgcagaagagaacgcggaacttcctgcgggagttactgcaacctttatatcgcaatgtgccggagaccactctttattcaacgaccagacggctgactcgaaagtgagtgatgccatccttccccacggttctttttcacgggaactcggttcatccaaagtattaaaacttaaattacagactgccatccgcttgcttaatacctttcatatccgccagtcggagaagggagatgcttatccggatttcaatcataacttcattaaatattccagcgggtattatgtatactcgttagggcatatcctgatttagcttttcggtttcacacttccgtattgaagtgattgggtaatcccatttatctgttccgataaatgccggggaagtgtgtcttgtctctctccggtagtcgtcattcgttgcattttattttttcaatctaaaatcataccatgttatgtttagtttattgttatccacttttgccatgatggggcttaccttcgtcattggctttttcgttgccggagtaataaagctgattgcttctgcggctgattcattggctttctacagttcacaccaggaagagcttgcccggttgaaacgtattcggaaacttcatcagaaagtagctgtcttgataaccgaaagtgcccttagcgacgaggagtacgggagtgacgggcgtgaagacttcagcaggggcatcaccaaacatcccggagacaatcgcgggttctatcacggtgtcagtcccggtgagccggaacgcggactgatggattatttttatccggaagatacaagatccatgtttcttcgcaaagaagaacaaatgttacagcatgacaaaaagaacaataagaaagcatcttcaatcaataaaaacaaataaatcttgatagtatggaaagtatagactttggaaccctgtttcagggatttggaacaatgatggccagcggatggtttctggccagtgcccgtatgtttttaatagctttgggatttctgctcatctatctgggctggaagggtgtacttgagccgatggttatgattccgatgggactggggatggtagccattaattgcggaacactgattatgcccgacggagcattggggaacctttttctggaccctatgttatcggatacggacgcgttgatgaatacgatgcagattgactttctgcaaccggtatatacattgacgtttagtaacggacttatagcctgctttgtgtttatgggaatcggtacgttgcttgatgtcggattcttgttgcagaaaccgtttgccagtattttcctggccctttgtgctgagttggggactttccttacagtgcctatcgcttcgggtctggggttgtctttaaaggaaagcgcttctgttgcaatggtcggcggagccgatggaccgatggtgctgtttacttcgcttgccttggccaaacacttgtttgtgcctattacggtggtggcttatctgtatttgggattaacatacgggggatatccttatttggtaaagctgttgattcctaaacgtctgcgtgctatcaagatggtggagaagaaagctcctaaaaattatgacgcgaaagtgaaacttgccttttctgctattttgtgcgctgtgctgtgtttcttgtttccggttgcttctccactattcttctctctcttcttgggggtagctgtacgcgagtccggcatgaagcatatctatgattttgtaagtggtccgttgctttatggttctacctttatgctgggattactattgggtgtgctctgtgacgcccatttgttgctcgatccgaagattctgaaacttttagtgttgggtatgcttgctttgttattgtcgggtatcgggggaatcatgggtggttacatcatgtatttcattaagaaaggaaactataatccggtgatcggtattgctgccgtgagttgtgtgcctactacggcaaaggttgcccagaagttggtaagtaaagataatccgaactctttcatcctgggggatgcactgggtgcaaacatttcaggagtaatcacttcggctatcattacgggtatttacataacgattataccttatttataataatgttgtagctgacagaatgatttcatgagtgactgacagagcttatccatttacagtttgtatatttgtcgctctcagatagtttgaaagacaaggttatgaaaaaatttatccctcgatatacctttttaaagaataagtacggcagtgagttgctggtggatatagtagaactgaaagatataaagaaatatgtcgttaaaagttctgttcataccctgacttattatgacattacctttatcaccgaaggggaaggaagtttcattcttgataatcatacctaccggggcggtgtgggagatgtgttcttctccaagccgggagagatacgtagctgggatacaaatgcgattgtgaatggatatgctctgatatttgaagaagagtttttatcttctttctttaaagattctttgtttgtgcagcatctttcctttttcaatccggtgaaggaatcgttgaaaatacatttgccggaacgctcttttctgcgtatgttgcaacttctgcaatctattaaggaggagattgatctgttcagacagaatgacgttcatgtgttgagagcgcaactttatgaagcgttgatgctgcttgaccgtttttacgtgcagaccgtatcggatgcagggataaacaaggaaggacgcagtccgtatcttgttcagtttgtacagttggtcgaccgtgggttcagtgaataccgtaccgtgcggtattatgccggaagactgtgtattactcctaactatctgaatgaaatagtgagtaccgctatgcagataagcgccaagcaatatattcagaataaagtgatggaagaagcaaagcggatgcttgcttacacggatttgccggttgccgaaatagctttcgaactgaattatgaaacggtttcttatttcagccgttgttttcgccggtatacgggagaaactcctttgggctaccggaggggacataaaccataaaaagtgtcatttctgcctttgtttctgtcacataccctcttttttctttctgtacctttgtgtcagtgtaaaactattaaaatttagaacaatgaaagatgtagagaaaacgattgggaatctgattgataagcaaaagatcgcatttatcggatctgttgatatagaaggcttccccaatattaaagcaatgttacagccccggaagcgtgaaggtatccggactctttattttaccaccaatacctcttctatgcgtaccactcaatacctgaagaaccatcatgcttgtgtctacttctgtgactctcgcttttttaggggagttatgctgaaaggtaagatggaagtgcttacagataattccaccaaagaaatgatatggagagaaggcgatacgctctactatccgcttggcgttacagatccggactattgtgtactgaagtttaccgctatcaccggcaggcgttatggaaacttcagttcggaagattttgaggtagagtaggctgttttcaatcttaaaagctgattgaaaacagtgcttctacctggaattttccatagtcgatcggctggatcagccgtacgcctgtcgtgagcggataactcatacgcagtacattccaatcgaaaataagatcgcctccgtaagagctttgtgtgctccagttgcttttgcgactggcttggttgcgtgacaagtcataaaaaagatttgcacgcagcctgcgtatgtaaatcagtgaactgatgctcaggtcgggcgaaagcaggggtaaagcataatctgctttgaaggcccattgttggcgggtttgatattggaaatgatatccgcgaggcttttccagcagatgtttggggagatacagtgatttattgtcaaggtcttgatattggtaacccaagcgtagcatcaatccgtgattcctgatgatacccggccaataggtagtcagccgggcagcgtacagactaccgaaattttccttattgaacggggttttcaagtattgtagccgaagctggtaaccgtttcggggaaggatatcgcgttgtgcttttcgtctgtaatcataaaataggatttccgggagaatgtattggaagttgcgatactttccactatgatactcttgatacttattgtttgtgaaatagtaagtaaaagcaggctgtatgcctcgtatgcgttggttacgtgtcaggttgaaagggaggtaaactcgcgcttccgcttccagtagattgcgtccgggataatatcctttggtgatatcctgacctttgtcatctttggtccagccgatattgaaagccttatcaccatagtcggcagcaagattgattatagggaaccagccctgataggtgaatgacagtttaccgtggtggtagccttcatcataataccagccggcttgcatgatggcggtgttcagtgtattttgtgacataatggttgctcccggcttgacaattgtacttaaatcacttgcactgctgttcattgcttcggccacatcataatagaaaggtgcccagctgtgtatcttgaaagtatgtgtacctttatgatagcgtttgggggtgaaatcaatgctatccagacgggcagagtcaaggtcgaactgttcttgagcagccaatgtttcaacgaatggcatcggagcaggacggtctaaatcggccttttcaaatagcaaactgtcagtcggcaacgcagcaatccggtatccgtctgcttgataatcagcaaaaagcagatggttgcctgaccgggaaaatgaaggatcgaatgcaccgaaacgagcggctgtcagccggtaaacctgtttgtcggagagatgaagacagtagatattatttgtgccgttggctcccgactcaaaaaagagttttccgtctttccaagtaggagaggtgatgttggccgaggtggtttttatcaactccttccactctccggactgcggattgaattccaacagactggttcccgaatcggttacggctatggagaaaatatcaaggccttctccgaatgtgagttctttgataaatgcgttgtcaggtacgtcgaaagaggatagctcttttcccttttctgcatttatcaatacaagttggtttttgccttctacagtggggcgggagaccgcaatggtctgaccggacttgtcgatagccggggccagataacgttggcgcggggtgattgtttttatctgctttttatccaaatcataatatttcagaacggaatagttctcgtgcgtccaacggagcccgggaaccaattcactccagtaaatccggttgttccggaagtcaagacgactattgatacttccgatataactcagatgcttttctttaccgttgctgatggctaccagagagtttatatctttcagtccggatttgacggcaataattacactgtcattgatcgattggggatatcgataagaggtgtaggtttttgaggtagaagagaggtagtcgggcacaagtgtacaggtatcctgtttttcccattctttccgcaagaaatcgaatgtgtcgtgctgaagccgtttgaaactgcttcctgtgtaatgcttgaaagagccttcaaataataaattccggacataacggctggtacttttatcccagatatcagctccataacgctggcgggcatatgaagccatatcgtagcccaatgcataataagttcctgtataatttttgtaagatcccattaaccacttgtcgaaagtataaggctttccgcctgctaataattgggcacgatagatcatgttgaattccggaagacgtccccgtccgccgtttgacatggcagtttcggtgcttactgcatctccttcgagaaaccacaccggaagaaaaaaggaggccacgccggctgcctgttcacctattatataataaagaggtttgaagataccatgcatcacctttccggtctggaatacgtggcgcgactcgtgcaataccagatgtttatcccagctttgagtacttaggtccgaagaaggagttgtaatcagttccatccgtctcggtgcccaggaaaccattccgttggattgcatgctggccggatggagaatgaccgggaaacgggctttgatcggctttccaatggtcttggacatgtggggatatacattttcaagaaagagagcatatcgataggccattgaatcatttccttgcgggtataccagatcatagtgaggcagtttcgctatgttccatttaaaccgggcgggatccgacccgtaatccatgaattgtgcatgaagccggagcggtgccagcaggcaaagaagcgaaagaaacagatatttggattgtaacatgagctgattttaaatagttatctgtcgcaaagctataaaaaaatctcagtctgttctgttaaattcgtttatacatcaagaaattagtcatttctatgccgttcacatcgaccgtttgttctttttcggtgatatatccgtgtttttcaaaaaaaggccgggcggtgatacttacttccgagtgaaccgatacagcgcgacaattgcgggcatactcttcagcttttctcaacagactggaagcgataccccgatgctgatattggggatggacgaacatgctgtgcagataccctttagggttgatagaggtgaatccggctatttgtgattgtctgatatcttctgctaacagaaaacataagtcactttgaaataattcctgccaacgttgttgagttcctcgtccgatccatgcttgaatctgtaggtgattataatcggcagaacaagtgttctgtacgctttgtgtaaacactgtttgcagcaaacccatatcttggatccttgcttttcgcagccggacgggaggaatttgcaggtgtaaaacaggaaatggctttcccgttccgtccaacgcgtcgcggcctgtcacttcaaatccttgatgtagatagaatcctaatgctgccgtgttttgttcatttacgtctactttataaatgtgtttttcacggatggcgaattcaaccagttcactgccatagccttgttcctgggccttaggactgacaaatagcatttcgatacaatcggtgctcagtcccatgaaggcagcgatggttcccgcatcttcacggatgacataaagttgtactgcggcaaagtattcgttccggatcaaaggtttataaaactgtatatccgtttcggtcaggaagtggtgggtagtgcgaactgcctcctcccaaacctgaagaagctcgtcatactcgtgtatgtggggttgttctatcattggttatttgttaaaagtcagctttcttttcaatatatattctttgtccggacaccggatgggtaaattccagacgttccgcatgtaaataaagcctctccgctctcttaccgtagagttcatcgcctgcgatggggcaattcagacctgacggatgggcggagtgaacgcgtaactgatgtgtacgtcccgtttgcgggaagaaagcgatacgggttcgtccgtttttgcgatctattacgcagtatcgggtgacagcctttttgcctgattctctgtctgctttttgtctgggcctgtcaagaagatccggacaaatgggaagatcgatggttccttcgtcagtcggtaagataccttccagcagtgctgtatactgctttttaatgctgtggctttcaaactgcgcctgtaagtgctgatgtacttccttggttttggctaccaacaacaatcctgaagttgccatgtccagtcgatgtacgatcatcggtcccgtagcttcaggatagcgggctctgagtagactgtaggcggacagttcctccgattttccaggtacggagagtagtccttccggtttatggataaccagaagccattcgtcttcaaagagaatctctatttcctttggcggggcaggggctgttgccaaaggatccggttcgacatccagaccttgtaacatgtgacgtaaaatgggcccgcattttcctttgcaggacggatagtaataaccgtgacgcctgatttctgttttcggtgattctccccaccagaattcggccatggcaatgggcttcaatccatttaggtaagcatattgcaatagcttgggcgcggcacattcacctgctccggcaggtggtatctgctgaatggtttgttcgaagatagcacacaagttcttgctttctcctttggcattcaaaaagctgaattgatggaatagcttttgctgcaatgccgccgaacggtttttgcgttctgctttgagagattcaatctgcgatgaaatactttccagttctgctttcacttcggaaattcgctctttccaatatctttccagacgtttgaattctgctttctgatattggctttcacgtatcatggcagcttgttcatcttcatccggttgctgctgccggcgctgttcccgtttttcttttgccgttttcagagtctttctcgcttcggtcaatatctgttgtgatgaggctgtttctttcgccagcctttgttggagtttcacataccggtcactgttttgcaattgtccgattcggcggttgatagccgagatttgttcttcttctatcttgaagaaaccatccggttgcaacaaatcgtataccggtggtacaaagaaagagtgtgaattgcttccgcacaagttacccgagaaagcagccagatatcccatttgtccgttagaagtacggactatcaatacgccgaacatttttcctttgtccaattcttctttccatcttgtctgtttatttatgtaagcctgtacttctcctgctgccattacacataacggatgaggagtgtaatggaagggataagtaaacaagtggggcaattcgatgccggcaatggaggtctggaaggaatgaaacatgctattttattggatttaaacgggatcttgtgcgacaattttcaaaagttcctcgaaggaacttactttatcatatttaagctttccaccgtttacattcgcaaaatgttttttggcacattctatctttgccctttctatttcccggtcttgcagggaagaatcgctggctttggtttcggctataaaataaggatacttcgacaacttttgtttgaagacgatggcccagtccggatggtattttcccattggagtagggatatagaaactgttgggtagttttacataagcttctatttcgtcattttcttccagtttttccatgaatgttttttcatttcgagagtcgaatctcacatggtcgtacagatgtttatctgctttcattgtgtttactcccaaacatccttgaacagctgcctgggtaaagaccgatacatcatagtactggtcgattgggctatattcgatatgttgtactatcagacgcgctttttcttcgttaatcagttccgaagccttaataataaaatcttcgggattatttctgaattgggcgaatacattcggttttatccgggcaagaatctgagcaactgcctttcgggtcagatttgtggcgtttgtgagtttaccgagtaagtcatattttacttgatcgtttgccatggcatctatcttttcatagtgcgcctgattgggatctactttaaatgcctctcccgaaaccaaagttgctttagacttgatttcgtccatttggcctgtaatgacagaaagatagagctggggtactcttaacttttcatttaagctcccgattgctttctctaccaattctttttcgtcaaactttacggtgtaggttgacttgctgcatagtagctttagcaattcctgaagtttgctgttttcaagtttatctttcgacaaccgaagatttatgttgtatttccttgcatcgtccggctgcatctctcttggattatagatagaggttaggatggtcatgatagacgccttataatcggtgagctcatcgtcgaaaatcacttctccctgtttacggtcatcatagaatttgtccgtcagttctcctttcttgatatacttgttttcaagtaaagagtcgtagatactttgtgctatatcttcggttgctatgatggtttcaccattaggcaatcggagagtcttgtccttgaataattggatagttactttttgtgggcggtcggctatggcttctgccatttctgtctgtaagcctttggcaaacgattcatacgattcactggctatcacggtcagtaggttgacacgatgcacttctttgcctaaaacgttggcgtccatgcgatctccctgtccgtttacgcagaggcgcagcccgcgtcccacctcctgacgcttgcgtacctctgccgaactttgtttcagggtacagatttgaaagacgttcgggttatcccatccttcccgcagggcggaatgtgaaaaaataaagcggatcggctcttttcggtcaagcaggcgttctttatttttcataatcaaatcgtatgcctcctcatctgttgattctttggttccccgctcggttttactgtcaatcagctttccttttctatctttggagaagtacccttcgtgagcttttgatgccacggtcgattttagataattgatatattccggctgattgaataacgaaaggtccaagtgctttatgatatcggtatattcctgctcgaaaatctcggcatattctccttttccgtccgggttatactggcggtatttggctacttcatcgatgaagaaaagggagagaactttgatgtctttctcaaacagttcctgttctttcttaatatgtgataagatggtttctcgtatctggatacgtcgtagttgagtttcgttgacgctacccgttacgtcacctgcataaagcttgatgccgttccggaaggtgacggaattttcaacgccgttgatatctgtaattacatagtcgttccggtattcttccagacggtttgatttagcgtacaagtcatcatttactttcagagcccgtactacctgattcactgctttggttctttttacttcgaatccgatattggcagtcggatttttgtccggatacagatttaaaccttccagatagacgaagccttcagtggctgttgttccactgatggaaatacctttgacggcaatcttcttaaccagtttcaggttgtaagcttccatcgcgtccaggcgatagaccaggttatagagttcgcggtgtgtagccgaataacgcagtgtgaacaggggattgaatcgtttcaatccctcttttgttttgactccttctaccgactggggttcgtcgataatcagtatcggattcatctgcgcaatcacatcgataggacagctgccgccaaaatcatccagtttcatgtagatgcggcgggcgtctttgttcgtagcattgaacttctgtgaattgatgatcattacatggattctgctgtctgtgacaaatgcgttcaattcacccaactgtttggagtcgtagatgaaataagacagaggggtgctgtaatccgaggcaaagtgttccttcataatctccaggcttttgtggactccttcgcggatggcaacactgggtacgacaatgatgaacttgcaccaaccgtagcgtttattcagttcgaagatggttttgatgtaggtatacgttttacctacacccgtctccatttcgatggtgaggttgtatttcccttccagtgcttccgacggtttgatttgttgggcacgctggatattctggatatgtctcagaacgatttcatctgtgagttggggtacgacagggtggttacggaatcctgtaaacctttcgtaactggtctgtccgtctttcttccgggtctctacttgatagtcgagcatcttgtatggctgcccggcaaagacatcacataccgcttttgctgcgtcttcctgaaacttttgatgtttgaattttaatttcatttctgtaccttccttctctgtttaaagaatctcgatcatagtaccgggagataacgttttaaatatctcgtctatattgatacgatcggcactatcacggaatgatgcgtcccgaaagacgacccggcgcggttgcctgccggctatttcacggaagactttttcgggaatctgttcagcgaaacatgccattaattcggtcttgtcgacagaataaaccgtgtatccatttatatcctcttcattgtgtgggagtgacagggatagtcccaggttggtcaggcaaccataaagcagatcgagtccggtacggtcttctttgatattatcagtgaaatagaataaatcactctgtgaatattcctttgcactgtagtacacgtccttcatattgctgtcggcaatccgaaaaacacggaaaccgatgtccgggcggttctttaatttaagttggttgcattccgcctcaatcgtgtctccggcacgtcgaatacgctctttggacagttcgcagatgttcaatgctttatgcttttccgtgagaaagtcgatcgcattttgcatgatctctttttcactgggagtcttggccttttttattgtttcagtcacatcttccggcagttgtacgagaatgtacttcaccttgtttttacgcggtttcatgttcatccgcataaccgcttcggcagtagtgccactaccagagaagaagtccatcacaatacaatctttgtttttggtgtcgataaactcacataaatattgaatcagactgacaggtttcggaaagttgaacactttcttatcaaagaactgtagctgatagttaccggcctgctcattagtttcaactcctactttgtaattgatcaggttgggtggaacttccgggtcatattccagtttttcgtacgaaggacttaacttaagagtcggtattttgatggttgttcctttttttatctctttctccagattttcctgactccatttgaatttggctttcagcttgacgggggctgtaaacagtccgtcacgtacggtggtatcttccagtaattccacgtcatacgcatctgttccgtacatgcccgctttgatcactccgtcggggatggaagtaactactttgttggccgggaaagtcagaatgccgacggaattcggttgattcaacagaccgtttgaactgaccgactccttcttcagaccctggaatttcatgtcgtttttcttcttctgatagcagacgatgtattcgatgatttgcttgctttttttcgagagattttccggagtttccgtctttgcccaattaaatacatcgatgaaattagaagcattgaatacttcattgcctattttaatcagatttgccagttcgtgatcatcaatggaaatgaaaatgatgccattatcatttaacagggtatgggcaagcatcagccgggcatacatcatgctacaccaatcggagtgaaactttccgttagcctccgtattctgaaacaatcgttgtccttcttcattatatcttccctgtttctcgtcggattcttcctgtgaaagagcgaatgtatcattgaagataaagtctttacccgtgttgtaaggcggatcgatatagataacgtctacctttcctgcataactctttttcaggagtttcattgcgtccagattgtctccctcgatgtataggttttgggtctgttcccaattcctgctctcttccgggcagggacgcaatgttttgcggataggatgcgccgcctctcttatcgcctgcttcttgcccacccatgttaattcgtaacgttcgtcgtcatcatataccactcccatttctgcttggttggctgtaaggaggaatttcagtttatcaaagtcgatagctttatgtagttgtccgtccttacccatcgattcagtgactacgttcgggaagagttcggctattttattcaggctgtcctctgcgatactcacagattccatttttagcttttccatatatgatttcatttttgtcctgcaaagttaagattttcattctgattggctaatttcctctataaataatgtgtgttttgggaagtaacgtacctctattccgaaccggttgttggattaggtaataaggtaagtgttttatcttgctgaccggatagtcttatgttctaatcatcaatcgaaaaacaccctcatgtttttcgattgatgattaggaggaaacgggcataggatgtgaaggtgtttcttgaattataggaagcaagtgtatttacttgtatttattttcatagaatatgccttttctgaatacttttgcctatttttgcgtattcaatctattgacagaatggagtaatatttagttgaaattttatagtaaaaatcatgaagaacgcaattggtaattgtaagcagcgaaaagcagtgctcttcgctctcgctttgcctctgatgttttccggttcgcctatgcaggctatgcatcggtccgaaatcgttagagaagtgacacaacaaaacttgaagatcgttagtgcaaagaaaatcaatccgactacgattgaagtactgttctctaataaccagagaatgacattcgatttctacggagagaacatcttcagagtatttcaggacaatgatggaggaatcatccgtgatccggaagcgaaacctgaagcacaaattctggtaaataatcccagaaacacagtctctacgcttgacttaaatgatggcggcaatctcctttctatcactacggggaaaatcaaggtggaaatcgataagaatacctctttgatgaaagtgatcgacttggaaaagaataccgtagcttttgaagaagccgaaccggtactttttgataaaggaaaagttactgtaactctgaaagagaaccccaacgaatatttctatggcggcggtgtgcagaacggacgtttttctcacaaaggaaaagcaattaatattgtaaacgaaaatagctggacagacggtggagtagcttcacccacacctttctattggtctactaacggctatggtatgatgtggtatactttcaaaccgggtaaatatgatttcggtgcggaagaaaaaggtaaagtgaagcttatgcacgattctccttaccttgatgtattctatatggttagtgatggtgccgtagggattctgaatgacttttatcaattgaccggtaatccggtgttgttgcctaagttcggtttttatcagggtcacttgaatgcttataaccgtgactactggaaggaagacgaaaaaggaatcttgttcgaagacggaaaacgctataaggaaagccagaaagataatggtggaatcaaggaatcattgaacggagaaaagaataattatcagttctcggcccgtgcagtgattgatcgctataagaatcatgacatgcctttaggctggttgctgccaaacgacggatatggtgccggatacggacagaccgaaacccttgacggaaacatccagaatctgaaaagtctgggcgactatgctcgtaagaatggtgtcgaaatcggtttgtggacacagtctgacttgcatccgaaagaaggtgtgagtgcattgctgcaaagagatattgtgaaggaagtgagagatgccggtgtgcgtgtattgaaaacagacgttgcatgggtaggctggggatattccttcggactgaatggtgtggcagacgtaggtcatattatgccttattacggagatgatgcccgtccgttcattatttcactcgatggttgggccggtacacaacgatatgccggaatctggtcgggcgaccagacaggcggtgtatgggagtacatccgtttccacatcccgacttatatcggttcaggtctgtcaggtcagcctaacatctcttcggatatggatggtatcttcggcggcaagaatatgattgtcaacaccagagacttccagtggaaaactttcactccgatgcagctgaatatggatggatggggatcgaacgaaaaatatccgcatgctttgggcgaacctgccacttctatcaaccgctggtatctgaaactgaaatcggaattgatgccttatacttatagttttgcgaaagaagctgtaaccggaatgccgcttattcgtgctatgttcctggaatatccgaatgcttatactctgggtacagccacgcagtatcagtttatgtatggtaccgacttcctggtagcacctatctataaagccacaaaagcagatgctgaagggaatgatatccgtgacggtatttatctgcctgaaggagaatggatcgattatttcaccggagaaaaatatcagggtaactgtgtactcaacaactttgctgctcctctctggaaacttccggtatttgtgaagaacggagctattatcccgatgaccaatcctaacaataacgttgctgaaatcaacaaaggacttcgtatctacgagatctatccgtataagcacatgatgactgttgaatatgatgatgacggtgtatcggaagcatataaggatggtaaaggtgccacaactttcattgagtcaaatgttgattcgaaaaacaatgtgaagatttctattcgtcctacacagggtgatttcgacggttttgtaaaagagaaagctactgagtttagggtaaatattactgccaaaccaaagaaagtttctgctcaggtgggcaaaagcaaagtgaagttgatcgaagtgctctctatggatgatttccagaaaggtgagaatgtatacttctatgatgctgctcctaatctgaataaatttgctacgaaaggcagtgaatttgaaaagaaggtaatcactaagaatcctcagcttcttgtgaagttggctgctactgacattactaaaaatcaggttgtgatgaatatcgaaggcttccagtatgcgcctgccgataattacagagttacgtccggttcgctgactgctcctgcagctcagattactgccgagaatattgaagcttacactttgaaacctacatggagcaaagtgccgaatgccgatttctatgaaatagagttcaatggcatgttgtatacaacaattaaggatactgagttgctgtttgacgggctggctgctgaaaccgactacgcattcaagatccgtgccgtaaacaaggatggctattcggattgggctgaattcagcgctaagacaaaagcgaacccgctggaatttgctcttcatggaatcaagggtgaaacaactgcgaagaatcaggaaggatttgatattgatcgtttattcgactttgccgaattgggtgatatgtggcatacgaagtatggagcaaaagcgctgccatatgatatgattatcgacttgagaactgtgaaccagttggataaattcgaatacctgccacgtaccgacggtggtaacggaacgattctgaaaggtactgtatattacagtatggataaagagaattggactgaggccggagcaatcgactggaaacgtaatggtgatgtgaaagtatttacatttactgagcgcccgactgcacgctatatcaaactggctgtaacggaaggtgtgaacaattatggttcgggtagagaattgtatgtatttaaagttcctggaacagagagccgtttgcagggtgatatcaataacgacggtaagatcgataataacgatttaacttcgtataccaactataccggtctgagaaaaggtgattccgactatgaaggctatatcagcgtaggtgatatcgaccagaatggtttgatcgatgcttatgacatttctgttgtggcaacacaattggaagatggtgtcagtgatgaaccgattgagaaactggatggtactattgagatcagtacggctaaacgaaattacagtaagggtgatgtggttgaagtgcttgtaaaaggtgtcaacctccgttctgtaaatgccttgagttttgcgttgccatacaatcagcaagattatgaatttgtaggtgtcgaacctttgaaccttaaagcaatggaaaatctgacttacgacagactccataccaatggtacaaaagcactctatcctacattcgttaaccttggagctaaagaagcccttgaaggaacaaacgatctgtttattctgaagctgaaagcgaaacgtgccgtgaagtttgatctgaaagctattgatggcgttttggtcgacaagaacctgaacacacgtaagttttaaacttgtgtaagaatactccgccgtttgaacggagaaaaataaaaagctgcccggaaatttccgagggcactgaaaaaacagatggcttttcagtgccctcttgaagggcaaaagtgagagtcgccaagttagaaatactaacttggcgatttttctatttggttccagtaagtaaaatgcttcacataacggttgacatcgtacttacgaacgtagttgttaaaccgagttctgttcaaaaaagtggaaaagttgagaaaaagtgtatttatcttgattcatcattacagctgcaaaaatagaaattcaaatccgttttatttcaaaatataacttaatcgactatatttcaatcatttcaaagaactattatttactttaacggaacagtagtgaaacatttattatataaatacaaaatattatcataattcatagtaataattatattaataatagtagctttgttactccttaaacatatagttaaacaatgaaactaaaacacaaattaaactatatactacaatgaaaaacatgaaaattgcatcctttatgataaaattcataatgatgcccctgcttgtcagcacttcctgtgtaaatgaaatttcagaagaatcgacaacccttcccggagaaattcctatccgcctttctacacaaattttatgcaaccccacacgtgttattgataacaaatttcaagaaaaggacgccattggcttgtatgtattgacacaaccatcaactatcaatcagaaacgatacattgacaatatgcgtttcacatgttcccaaacctccggcttcgaaccggaagaaacgatttattatcctaaaggaaacggagaatgtaacttcatcagttattatccttttcaagaaacaggtattgaaccggacaaaagtacaatgcaggtccagatacagaccgaccaaagtactgtgggcggactatcactttccgactttatgatcgctgtaaacaatgacattacacccagccagaacatggttgccatggaatataaacacaaactttgcaaactggaaatcattataagacccgcagccggagaagacttacaagagctcttggctgataaccctaccttatccttaaacggattccattcggaagcatcttatgattttctcaccggccaattcgggtcatcgggacaaacgagcggcattattccttatggagaatggaaaatagagaataatacccttataggcaaaaaagcgatactgatacccgaaaaaatagagtctgacagtcactacataaatatggaaatagatggaaagagctatagttgcccatttccggacaactttcagctgtccagtgaaaaaagctgttccataggcattatctataaatcatccgaaggtattcaaatcaacaacttcgatcatagcattgcagactggacagaaggggagtcgggtgaaacgacagctcaggaaacatcaggtataattcacctggctgcactgaaattcagtaagagtaatgtatataaagccattaacgaagggacgcaggtagcagagatctgtaaagagtatctattggcagacaatatcgatgcacaagccatcgtcgcctatcctgttctaaatggagaaacagatttaaacaacggcacggtaatttgtttacttgacgaaacagcagccgttcacggaggcaaggtctcttggaacaaaattaataatgtattagcctacacgcccggaaatcaaagcgtcatcaacgatttctacatagccgaagataactcaatatcaatatccaagccggaaaatcctctacctgtacgattgcaagaagatgtcttgacagatatacggaatacggaaaccaaaacttatcctatagtaaaaataggaatccaatattggatgggacgtagtttggaagcgacacgctataccgacggtaaaacaattactttgaaaaaggatttcacggcaacagcaggctattacaccgggaaatatcaagatgcgcctcaaaatttttacttttacaattctgaagctgttatttcaggcaagttatcaccccaaggatggaatattcctaccgaaaccgagtgggaacaactaaagcaatatataaacaatgatgcttctaaactgaaatctgggccatggtcaagcgatgaaagcggtgacaagcttcctatacttaacactacaggattcaatggaatgccggaaggatatattctaaaaagtaagaacggatataccaacggcttatatacggtggtatactggtctaccaattcatctggaaatcaaataaataaagcaatctatttgctgcatactacaaatgaaataaaagacggcaatataacagacagagctctttctgtcagatgcatccgtaaataacaagcactttgcctatcatacagaatctaaagtttaggtagatctcctcaccgctactggcccaaactttagattctgtattttatcgttaaattattctcttcattcgaatagggaatcttcttcttttttctgtctttataatcaagaaatcaattataaaacccaaaacagaaaacatatgcagaaagtattatttatcactacaattctacttacattattcgccctctctatccatgctgagcacaatcctcaaaaaagaccagatgcatctgcccaattccaaaccgtctccggtcacagtatcagtttaaatggtatcggactggcatatagttatgaatatgcttttgctccgaaaggtactgttatttttagcgcaggagcttcttatgcttttgaaagaacatggcaactcaaaatggaatcacttcgcgaattccatatcgctaccaaagactatcatttagtaaccggagatttagccatagaaccacgtttttattataacctgaagaaaaggcatcgcaatggcaagcgtacttggggtaattccggtgggtatttatctgcctgtttcggatattcttttccaatagccatcagcagcggagtaaaaacagcgcatatatatgttatcaccccatattggggatttcgacgcgtatggaaacattttcttttcgatctatctggcggagccggttatataaagtcctccaacggcaattccgccatctatcctactgtgagaataggactgggatatagattttaaacgtcatactctaattgaagaataaataaccaaagtaccgaatacaaaaaatggctactcatcccgagcaaccaatcttttgttaaccttaaatctaatacttatgaaaaaaacacaatacaaatataccgaatttcaagcaattagcaaatatcagagcaaaaatatcctgtattataacaccgtttaatactcgatcttgttttgttaatactttaggctaaaaacgttaacaattaacacattcgttcacagttctcctgtagctctatagccataggaaaaacaatattattttctaaatgaatatgatgatgcaaatttttctcaaatgtctccaacatctcaaataataacctgtaggtgtcacaagcatcatcgggtactaaatatccctgagccaataaagaaatccggcgaaaacgttcaccttcggcatcatgttcatgcatcattaccgaaatagggctactgacactgccacaatgaaaaggcggaacggggcggtgttgggtcactgcatcgaacaaatcgtatatataaggaaacaacaccatttcctccttggtaagatgattattcagatctatccaggactcctgaaacaacccacgtatctcatgaagttccggatgcttctcaccgtgtacctcacaaactttatcaagcaattgaagaatctgcggtccctggtaacggatattacgatgatggaatttcaggatgtaatctaccaataaatccataggccaacttttaaaatcaaaaatcggagaatggttcggttgcgtttgccccaactcttccaacaagctgtccacccctgctccggctctttcacaagcatcagtcagcgagacatctccattgcaacagaaatcaatgccatacttattgaatacctttgcgtgatcaaaacgatcggctacaatctggccgactgtcataagtttataatctttcatattttcctcttttattattcagaggacaaaggtagggaacagaaaacaaataatttgtaaccaatgttacaggaaggattttcttttgtctttcgaagcaatatgaagtataaaacaatggcatacacagttttctataacttgtgtatgccatattcttttcttaattaaaataatacagaaagatagcgataccttcgagtgctttcttaggctgatctttaatctcaatcgcaaacttaatttcagctttagccacaccacgcaagttagtaagagaatgcagacttgccttcagtcgcacactttgacctgacagtactgcttgcccgaacttcatcttgtccataccataattaatcatcatcttcaaattatttacttcaataatctgattccacaaatgaggaagtaatgacaatgtcagatatccgtgaacaatggtgctatgataagggctctccaccttagcacgctctgtgtccacatgaatccactgatgatctaatgttgcatcagcgaaaaggttgatacgttcctgagaaacctccagatagtcagagactccaatctgctgccccactaatttctcaaaatcttcataagaattaataattactttatccatatttcttcatttaaaaatgtacatctttgctacaaagatatattttttttagataagttaaaattaatccggtcttttagattcttcatcagaaaaactcgccggcttagtacatgaatctactttcccaaatatccgataccgatatttggaaaccaataaatacaatgcatcccttacttttaccggaatcaggatcaatggataaaaacactgccagaatcctcccaggtcttttaagatataaagtatagccgtagatttagaataacaatctcctttccgaaaataatagagagtcttattactactttcaacagcataccggcccaacaaagttttacccgcttcagattgcagtgaaacaaaacggaacagctttcttttatccctctttacaataaaagaaactgtcccgttgcagagattacatataccatcgaaaagtataatattcattctatttttctaaataatggaagtctcgtatgcactggtcaacatatcataatcggcatcactgtattctcctttttcccgagccttctgcacctgtttgataaatatttctacctgtgaaaggaaagtctgataagacttcatctcgctttcatgaccattcacggcaggaagttttttagcagcatcgagttgtttggtaagttcagctactttcaggtcaatgcggggtccatccatcatatgcttacgtgcatacaggttcaaaatactctgcatcgtagcagacatcttccgtacagacataatctgttctttcagcggactgtccgccagaagcacctgttcagcctgttcggtaaacggactcagaatatcaaaaacattctgcttgtattcagacatctgtgtgctcaactgataattcgcatccaacagttgcttcgctttggttacatctttctttttcaagtaagaaagataggtatcgaaatttgcgtaaaactcagctctcgccttaaacaatccggcatagttctgcaccagattctggcgggtttctctattgaagtaatctccgggattcatcaccgtcgccgaatcttttgcaacaactgccggtggggcgatggcggtaagagccggtacttttcctttttgttccatataatccaaaacggcatttacatctttttccttcaccatatcttttaatactccgagagaagtattataatatttgattacctctgtcgcattttcaatatctgccgtactggcaacaggagctttgctcttgcttccacccgaacaagaggccaacagaaaagcactcacaagtgctccaaaaaacaatagattctttttcataatgtttcctttaataattagtaaatagaacaagcctatagatagctgatattgcactaataacaatataaaagtcgttttgctctcaaaaccatctataaattacaaagggaacagggaaattaaagaaataaatatcatcggaagcgaaaccacattactgcataaaacaaaaaatggctactcgtcccgagcaaccaatcttttgttaaccttaaatctaatacttatgaaaaaacacaatacaaaaataccgattcccaactaattagcaaatttacgcacgatattctgctctattataacatggtttaatgttaccgataacttattaacatttcacacttgtattgttaaccattaacaagttccattactcgttttcagacataaaaaggctatcatacgtcatccacccaataacgatgatatccccaccggtacaatattactgaatttctttatccccctgatcatattccaatccttcagataacaatttctccgataacaatgaacatgttacaggtataaccggtatttcattcataacgaaatgaatgtagacctcaaaagatagtttataaccaacccacacaaccctatgcatttctgaagcagaaagatagaaatcagacaaaggcagtaatctattattcaattctaacagttcgaatgatggaaaaaaagagaagtcgatattgtgatattctttcaataatagaatcttgtcgcttaatttattctttttgatttcttgtatattaatgtttttttcttgctttagacatcagatagtggtatatttaccccgaaacacttcagcccgtttcttaaccttaaaaggaattgaatatgaaaaatttaaaataattattgatcgtactaatctttgttacataaaaaaacaaataaaacaaataaaacaaataaaacaaataaaacaaataagatgaaacaagtaaacacagttttgacagtcattctgttggtagtattgacaggatgtggaagaaataaacaatcaaacgatgatttaatcatcgtggacgtttcgaaaagctatcctaaaaaagaattgattcttcaggattttatgaatgtggaatatgttgcgctggaaactacagatgagtttcttacacaaggcttagtacaagatgtgggaaaagaatacttattggtaaccaataggaataatgatggggatatttttatttttgacaggcaaaccggtaaaggattaaaaaagataaatcggcgagggcaaggggcagaagaatatgcaaggattaatgagattattcttgatgaaagcaatgatgaaatattcgtaaagtcaccgggaaataaaatcttagtatacgatcttaacggagaattcaaacggtgtttgaatcttggtagagatgtttcatctatttttgattatgacaaacataatttgatctgttatgatatgtcagattatcataataaaggaaaggatagaaacaaatcgtaccatattcttatatcaaaacaggatggaagtatcacccgggaaatttttattccttttaaaacgattaacacaccgattgtgactgatggagatcgatttatagcaaattattcttaccaaatacgcctaagcaacggaaaatggacacttatagatgcatcagccgatacattgtataactatgcaccggatggtacattaagcccctttattgtaagaaccccctctgcaaatactatggagcctgaaatttttctttatatgggtattcataccgaccgttattactttatggaaaccgttaaaaatgtatttaactttgaaaaaggtaacggattctatacagatgagctggtgtacgacaagaaggaaaaagccatatttcaagttgccgtatataatgatgactatgcagaaaaaagaactgtagctatgacggcgaaatcaattaatcgcgatatcgaaaatgtcacgagtttaagtgcatcccgacttgttgagatttataagaaagagcaactgaaagatggcaaattgaaagaaattgcttcaaagttgaatgaagaagacaatcctgtaatcatgttggtaaagcaaaaaaaatagtggtttaaaatgaaaaaggcaaccaactattttatcaagagcagcggatcatccaccacctgctgaacactccttttattccattcgcaggattgttgaccgaatagagggtgttgctcttgttctttacgtatactatgaggttgtgtcaaagcgtatttgacacaacctccttttcacatttacattcaatcattataaaaataactaacctttcatcatgctatgcttatcatgattttatttagccttttacggtaattcgtttgtaaccatatacagcacggtcacccaattcttcttctatacggagcaactgattgtacttcgccatgcggtccgaacggctcaacgaaccggttttaatctgtccgctgtttgttgctacggcaatatctgcaatggttgcatcttctgtttcgccggaacggtgagaggtgactgttgtatatccgtggcggtgtgccatttcaatagcgtttaatgtttctgtcagcgaacctatttggtttactttaatcagaatagagttggcacaacctttttcgataccttttgccaggaaatcaacattagtaacgaaaaggtcatcacctaccaattggcagcggtcaccgatacgttgagttaattttttccagccttcccagtcattttcactcataccgtcttcgatggaatcaatcggatattcgttgataagtttctccagatagtcaatctgttcctcggctgtacgttttttacccttttcaccttcaaacttggtgtaatcgtagataccgtcatgatagaattcggaagaagcgcagtccatgccgatcattacatccttacccggttcatatccggcagctttaatagcggcaaggatagagtttagtgcatcttctgtgccttccagattcggagcgaagcctccttcatcacctacagctgtactcaaaccacggtcttttaatacttttttcaaggcgtggaatacttcagcgcccatgcgcagtccctctttgaaagagtttgcaccaactgggcgaatcataaattcttgaaaggcgattggggcatcgctatgtgatcctccattaatgatattcatcattgggacgggcaaaacataagtatttgtgccgccgatatatctgtaaaggggaatatcaagataattggcagctgctttggctacggcaagtgaaacacccaggatagcgtttgcacccagtttggcttttgtctttgttccgtccagtgccagcatagcatggtcaatgcccatttggtcgagggctgacataccaatcagatgtggggcaatgactttattaacgttctctactgctttctgtacacccttaccgccgtaacgatgtttatcaccgtcgcggagttcaagcgcttcatgctcaccggtcgatgcgcccgacggaacggatgcacgtcccatgatgcctgattccaatactacgtctacttctactgtagggttacctcttgagtcgagaatctctcgtcctgtaattttttctattttcattgtttctcttgtttttttagtctctgcaaatgtactcacttatgggaagcggtagaataactattaataggtattccgtgcggtctctttccctataaatcagtattatcgcttttatactataaaacaaagagagaggtggaaaagttcagtcgtcttcaaccttgactcctaacagaggcagtaagtccattgcctgtaatgaactgactatagcccctttcaggtcagctatgtttagttgaatgcctgttattcttgagctcctcaggtcgatgccttttaaagacgtatgcgaaaaatctgcttcaagcagttcacagttgtcgaaagctgccggtattaatttactgtcattgaggctggcgtttcgaaaatcacaatggctgaaacgaacggtccgcattttcgtcatggaaagattgatgtattgtccataacaatgctccatccggacatggtttagggtggcttccggaaaacctgttcctaagagcttgcatgatataaattctacccggtagaaagtagttccggcaaaggacacgttggataagtcgcaattttcaaaacgtatgtctgttaattgggctgacttcaactggcattcgttgaatatttgttgtttgaaagtacaattgttaatacttagatagggcttatttacttgtcggacaactcctttagaaaaatataaatcagaaattttctcttcatccaccaaaatatcgagtggagtgatgctttcggactgctcattgatgaatggggctatgactttaacaggttggactttcttaattgctggtttcatatattagtctattgttttaaatgttctccgaggtatcctccacctaatacggctaaaagcccgagtatcatactggctaatgtgtaaaatgcgaatatgccgtagaagcctcctttcagtaaactcaggccatcattagccaaagtagaaaatgtggtaaaacctccacagaaaccaacagtcagaaatagccttaactcgaaggatagatcaagacgttccgaaagtgaatagaataatcctattaacaaactcccagcaatgttcacggcaaacgttccccacggaaaggggaaaaaagtagggctaagtttctcgttgacggctatttgtgccagatagcgggatacactgcctatgcctcctccgataaatatataaataatctctttcatcttttttgttttgttggcaaagttaccactgtcaactgtttatgcaaacgttttctgataaatcttctttatttcggttctattcgtcgaaccggaatctgcttcttgcttatctttgttgcatgattactaatttatattaaaccatatcatgaagaacatgaataaactgacttttaagttggcttgcttttttctttctcttttagtgagtagtgtggcaatggccgaaagcattacttctccaaatggactcttgaaactgaacttttcggtgaatggaaaaggcgagcctgtgtatgaactttcttataagggtaaagaagtgattaaaccttctaaactgggccttgaactgaaagatgatcccggtctgatggatggttttacattgattgatgccaagacttcttcttttgacgaaacctgggaacctgtttggggagaagtaaagcaaatccgtaacaattataatgagcttgcggtaactttagaccaaaaagctcaggatcgtaagatgttgattcgttttcgtttgtatgatgacggacttggttttcgctatgaatttccgcagcaaaagaatctgaattattttgtgataaaagaggagcattctcaatttgctatgacaggcgatcatactgctttctggataccgggcgattatgatacacaagaatatgattatactcgatcgaagctttcggaaatacgtggcctgatgaaaacagctgttactcccaatgcctcccagactcctttttctcctaccggggttcagactgctttacaaatgaagaccgatgatggattgtatatcaaccttcatgaagctgccttggtggattactcttgtatgcatcttaatttagatgataaaaactttgtttttgaatcatggctgactcctgatgcacagggagataaaggatatatgcagactccttgtcagtctccatggcgtacaatcatggtcagtgatgatgcacgtgacattcttacttccaaattaacattaaacctgaacgagccatgtaaattggaggatacttcctggattaagcctgtcaaatatgtaggtgtatggtgggagatgattacgggtaaaagtacatgggcttatactgacgacgtttattcagtgaagttgggtgagaccgattatgctaagactaagcccaatggacgtcatggtgccaataatgagaatgtgaaacgttatatcgattttgccgctgaacacggttttgaccaggtattggttgagggctggaatgaaggatgggaggactggtttggcaagtcaaaagattatgtgtttgatttcgtcactccatatcccgactttgatgtgaaaatgttgaatgaatatgccaagaataaaggggtaaagttgatgatgcaccatgaaacctctgcatctgttcgtaactatgaacgccatatggacaaagcttaccaatttatggaagataacggctacaacgctgtgaagagcggatatgtaggcaatataatcccacgcggtgagcatcattacgggcaatggctgaataatcattatctctatgcagtgaagaaagcagctgatcataaaatcatggtaaatgctcacgaagccgttcgtccaaccggattgtgtcgtacgtatccgaatctgatcggtaacgagtctgcccgtggaacagaatatgaagcttttggtgggaataaaccattccacactacattgcttccttttacacgcttgattggtggtccaatggattatactccaggtatttttgacactcaattgtctttcttgagtggtgaacatagttttgtgcataccactttggcaaaacaattggccttttatgttacactttatagtccgctgcaaatggctgccgaccttccggagagttatgagcgccacatggatgcatttcagtttattaaagacgtggcagtagactgggatgacagtaaatatattgaagcagaaccgggagaatatatcacggtggctcgaaaagccaaaggaaccgataattggttcgttggaggtattacaggtgaaaattcccgtacttctacattcgttcttgatttcctggatccggggaaacagtatgtagccactttatatgctgatgggaaagatgcggattatgagaagaatcctacctcttatgagattaaaaaaggtatagtgactaataaaaccaggatttctactaaattggctcgtagtggaggtttcgctctcagtctgatagaagctactccggccgaccgaaaagaacttaaaaagtggaaataaaggtgggttagtggtaaaaaggttagtttggttatttttttgaaatgaaagagtccggatacacaatatgtatatccggactccttttgttggtagttactatattatcaattaagtgagtcatctcttgactttctatttttatctgctgttcttatctttattgattatatcgtttttaatcaagtgattaatagtctaatgttgaatgtttataaagctaactttaacatagagttaaagcttgttttttgaatgcaaagaacaagttgtttgcatttaaaagatttgttctttgtacagagggaataacgatctttgttttctccttaacattgttaaattattctgttgtgattatatctttgctttgatagcttttgttccctatatataataaggtgtaaacaactctacttattagctcctccatccagtaactcggctattttctttttcaggtttagcttgataatttcatcttgctgcagttctatttctactgtaattttggcatttcccaatttatatctgatatcttcgttatcataatttctctgttcttgtttgatgctatataaaagggcaaaatcataatctaacgccagtgaaatattatataatgtatccgtatcaatgcttttccttgtcagtagataatctacactttgaggcttaacgtccaatcttcttgcgagttcagctttagtgacctgcctctcggacattatattcttgataatttcacctatataaatattgctctttttcatttgcatgaaagtacaacataatccgaagagttaggtttatcgatataaaagaatctctgttcatttttgtattttgttcataatttatttgttttatcagataaattgggatatatttgcagcggatcactgagagaagtgaaacaacactcttctggtagcagaagaaaaacagagtggaacataacatttatattattactattattcattaaaattttgagattatgaaaaagaaactcgtgatggtagcagtgctcctgggtgctttgtcactgggagcttgcgttgataacaacgaatcgacttcagtagaggcagtgcgtaatgcgaaagctgagcagttgaaaggcttggcagcattggcaaatgcacaagctgaggctacgaaaattacagctgaagctgaggctgcattaaaaaatgcacaagctgaataccagaaagaaatgactgaagaggctaaacagaaatttgctgttgaaattgaacgaattaaagccgaggcggaaaaagcaattgctgaagcaaagaaagctgcttctgaagctgaactggctattttaaaaaatgctgatgaacgtgttcagtggttatacggacagtatactatagctgctggtgaattggctgttttgaatgaaaactttcttaccagaacagccggtcttgctcagttagaagcaggtataactacagcagaagcaaatgctaagattaacactattactttgaatagaagtatcgcagcggaaactgctaaattggaggttctgaaagacccagttaatgcaaatattgataaggatgcgcttaacgctaaaaaggaggctgctcttcaaaagtataggttagccaatagtacagtgatgaataatgaaggtgctgctttggatgcagacgccaaaggtattcaggaggctattgatgctttggatagagatgcaattgatgaggtaaataatctttattatggtgtcgttgcatttacaggaacagaatatttgcagtgggaatcgactactggtattaaatctgatgttgttaatttaggggcttatataagtgaaagccaaaaacttgaagcagaaacatcttttgcaaatcgtgtaaaaaatgctgcagatgctttgggtacgtcagcagatactaaggataagaatactgcttatggtcgtcttgcttctgctaatgcacagttggaagatgcaaataagatgggtgaaacaacagatgcagaaaaggaggctaaagagcaagctatagaaaatgcaaagcgtgcaattgcttctgcgaaagatggtattgtgattgcacaagctgagtatgataaagaaaaggctgcttctgatgaatttgctgctgctcttgcagctgttgatgtaaaagcatataatgatgccgttagtgcaattgtagcattggttaaagcgaatgaaactgttgctaaagcatttaatgcaaatgagactccgatgaaactttggagtgagtatagtgttcttaatgcactttataataatagtcagaaccttgaagaattaattgctcaatgtgaattaaatattgctcaggctaaggaacagattaaattctatgaagctaatatcacgaatgctgaggctcaattagctaagggaaaagaagagttggataatctggaaaaagagattgctgctaagaaaattattgttgacaatgcaaaagctgcgttggatgcagaattaagagctgaataatcacctaaagtaacggcagaaaacaacaaatcaaaaaaagtatcgtatgaaaataaaaagacttttagtgttggccgttctacccatgatgtgtcttgcagctaatgcacagaactgtagtaaagacaatactcctaaaaaaggagactttacggtagcagctactgttggatacaatagttacacaaatgtcacagccccttcggggctgctgactgactatgaagtcagagcgctttcaaccaactgggcagacaaaaagctgatggttggttttgaagggggctggttcttcaaagatcagtggaaactaaatttgggtggcggtgtcagcttcacgaataaccccggttatccggctgttcccggtacaatagacgaaaatacggagatcggtgatggaagtatccctaactaccgtgccgtagccgatgctcagtcgttcgcctataatgtgtcggcaggtgttgatcgttatttcaacatcaagcgtgttcctaacctgatgtggtatacaggcgttcgcgtaggttttgcttacggcgaaaatgaaatgaagtatgatgaagagacctctatgggcaaatcggttgccgaaagctggaatcttcgtggcgccctgactatcggtgtcgattactatgttcttcctgccctctacgtcggtgcgcaaatcgatccgtttgcttatacgtacaacaagactacgtataatccgcaagccggtcttggcgatctttcggcagacagccataactacagtgttttggcagctccgacattgaagatcggatttaagttttgacctctatctccatccggccgataggttatcggtcgggtgggtgattttataaataagtccatttatttatacctccccggtgtccgtgacggctgtcggggatttttatttattgtcttcttcaaaatcaaagtcaaaatcaaagtcatccataaattccggagtagtgaattcttcaatgcttcgacggtcttttttagtcgggcgtccggtgcctcttgcgcgatcaatgaaaccactgattttgctcatttccaaaagttcgtattgatcgggtgtcgttacgttttccatcatctcggatacaagctttgctccgattcgtttctcgatagcttgtaatactttgaaagagtatgtaatggggggcttttttacttgaattacgtctcctggctttatcatacgagatgctttcacaaacgatccgttgatgctgattcgtccttttttgcaggcctcagcggcgatggtgcgggttttgaagatgcggactgcccacatccatttatctattcttgcttcaggcattgggttataaattgaaaatgaattattattttttgttgaattgattcatcgttatgtcgattcctgccaaacaaaaacttttggcaatctctccggctgtctccagacgctcgttcattgttgtccagtcttcttccgtaaaatgtcctaatacgaaatcaacttgtccgccctttgggaagtcattgccaatgccaaatctcaaccgtgcataattctgagttcccaagatagctgcgatatgttttaatccgttatgacctgcatcgctacctttgcttttcagacgtaatgttccaaaaggaagagccaggtcatcaacgatgattagcatattctccaatggaatattttccttttgcatccaataacgcacggcattaccacttagattcataaatgtcgaaggcttcaacagaatcatttgtcttccttttacagatagggtagctgtaaagccataacgaccgtccttgaatgataggttgtttgctttagccaaagcatccaacaccataaagcctatattatggcgagtttcatggtattctggaccaatgttgcctaatccgacaattaagtatttcatatctttcagtttatttgtttttaaataaaaacgcagattaacacagatgtgaaatctgcattaatctgcgtttgaatgatatctctaataaaggatagcgatattattttcctgctgcagcagctgcacctcttgccgcacgagtcaacttaacggcacatacaacagcttcttttgcattcagaagttccagtccttcatagctcaattcgcctactttaactgttttgccaagacccaagtgagatacattgacagtcagtttctcaggaataacgttgtacaaagctttaactttcagtttacgcatctgcaatgctaatttaccaccggctttcacaccttcagcaagaccttcaagttgtaccggtacttccattacgataggtttagcttcgtcaatctgatagaagtctacgtgcaggatagtatcttttacagggtgaaattgaatgtctttcaaaatcgcattcacttttttaccatcgataatcaggtctactacgtggatgtgcggagtataaaccagattgcgaagtccttcgttagtcactgtgaagtgaacaacttctccaccaccgtaaagtacacaaggtacaccaccgttgttacgaatttctttcaaagctcttgcctgttcagaagagcgttctgcaattgttcttgcagttcctttaacttcaattgatctcatttcttgaaattttttgtgttactctaaattaagttattttgcttgcttaattcaccatcacacgatgtgattatcacacgatgtgcaaaaagcggtgcaaaagtacactttctttctgaaatatcaaagaattgatgtttttaattattcaaaatcaatatctattttaatttcactatctaaaactgcagtttcagtttcgctttcagattcgattttttttccggattctaattcttcggtatattcttgattctgattgatataactgatcgcttgttcaagaccggacatgaatttaccaaaatcttctttatacaaaaagattttatgcttttcaaaacttacctgggaatcgtctccttctcccattacgacttttttgctttcagtgatggcaagaaacatttcatctttacggttctttttaacgtccagataatatatacgtttaccagctttaatcgatttggagaatacaatctctttatcattcatgtctgttcctattttctttttaaaatcttccatattgttaggtctgtttataattggcttcaaaattggatattttttttaaaccgtcaaaagaaaaaggaaagagaatgaaatactgcattaaaaaatgtgatttatttgcgtaaactcattaaaaatgtctacttttgcaattcgttaataacagtattaattaagattatgattaacagagttcttattcgtctaaagatcatacagatagtgtatgcttactatcaaaacggcagcaaaaatttagactcagcggagaaagagttgttctttagcctctctaaggcttacgacttatacaactatttgctgatgcttatgattgctttgacggaatatgcacaaaaacgcattgacacagcgaaagctaaattggcgccgacaaaagaagagttgtatcctaacatgaagtttgtggaaaataagtttatcgcacaacttgaagtaaataaacaattgagcgagtttatagctaaccagaaaagaacctgggcaaacgatcaggactttatcaaagaattgtacgagaagattattgcatccgatatatataaagaatatatggcttcttccgataaatcttatgaaatggatcgtgagttgtggagaaaactatataaaacgtttgttttcaataatgattcgctggatcaagtgttggaagatcagagtttatattggaatgatgataaagagattgttgatacatttgtattgaaaactatcaagcgttttgaagaaaaacaaggggctaaccaggcattattgcctgagtttaaagatgatgaagatcaggaatttgcacggcgcttgttccgtcgggccattctgaatgccgattattatcgtcatctgatcagtgaaaacacaaagaactgggatttggatcgtgtagctttcatggatgtgattattatgcagtgtgcgttggcagaaattcttagttttccgaacattccggtcagtgtttcgttaaatgagtatgtagagattgccaaactctatagtacagtgaagagcggtagctttatcaatggtacattggacggaatagttaatcaattaaaaaaagaaggtaagttgacaaaaaactaatacctttgtccaaatagattaaaaaactaaaaaactgattattttatgaacctattaactgtattttttcaagctcctgctgctggccctgatggtagtttgatgtggattatgctgatagcaatgtttgttatcatgtatttcttcatgattcgtccgcagaataagaaacagaaagagatcgctaatttccgtaagtctctccaggtgaatcagaatgtaattactgctggtggtattcatggtgtgattaaggaaatcaatgatgattatattgttcttgaaatcgcttctaatgtaaaaattaagatagataagaactctatttttgcagatgcttcagctgccaatagccagtctgctacgaaataaggaactaaaaataaataaagcctatgttcgaacgtaggaacataaagtatatttatttaaaattatcaagaaggattaaggactttctgcttagtgataagagcagagagttcttaatttttttatttttcttttttattgcaggtggattttggctgcttcaaacattaaataatgattatgaagcagaattttcaattcctgttcgtttgaaaggagtacccaatcatgtagttttaacttctgaacctccttctgaattgcgtatcaaagtaaaagataagggtacggtattgctgaactatatgttgggcaaaagtttctttccggtaaatatcgatttttctgagtcaaaggcccctaataatcatgtgaagatttatacttcagaacttgagaaaaagattctgggacagctcaatgtgtccactcgtctgctttctgtcaaaccagataccttggagtatatttattctaccggaaagtcgaaactggtgcctgttaaattagagggtaaagttactgcagggcgtcaatactatatttccgataccatttattctccggattctgttttagtatatgctcctgtagctatattggatacaattacaactgcctatacacaaaaagtgaactttgagaatgtagcggatacattgaggcaacgaattgcgcttgccggagtgaaaggagctaagtttgttcccggagcgattgatttaactttgcctgtggatatatatacggaaaagactgttgaagtaccattgcgtggtattaattttccggcagataaggtgttgagagcttttccgtctaaagtccagattacatttcaggttggactaagccgttttcgcaaaattaaggcaagtgattttgttgtaaatgtctcttatgaagaacttttaaagttgggcactgataaatatactgtcaaattgaagtcagttccacgtggagtgagtcatatacgcattcatccggagcaggttgattttcttatagaacaagtttcttcttatggcaattaaaattggtataaccggtgggataggcagtggcaaaagtattgtttcacggctacttgaagtaatggggattcctgtctatatttcagatgaagagtccaagagaattgtagcgaccgatcttgttatacgtaaggaactgtgcgacttggtaggagaggaggttttcttaaacggtaaattaaataaggtcttattggcttcatacctttttgcttcctccatacatgcttctcaagtcaatagaatcatacatccgagagttaaagagcatttcaggcaatgggcttcacacaagggttgcatggatattataggtatggaatcagcaatccttatagagtcggggtttgctgatgaggttgattatattgtgatggtttatgcccctttagaaataagggtggatcgtgcagttcggcgtgacaatgcttcgtgtgaacagataatgcaacgtattcggagccaaatgagtgatgaagaaaagtgtgaacaggcttctttcgttataataaatgatgatgagaaaccgttgataccacagattttagagttaattgctttcctatatcaaaagattcattacctttgctccgcaaaaaataactaatataaaagtaatatactatgttaaagactattttgtctatctccggtaaaccgggattgtataagcttatttcgcaggggaaaaatatgttaattgtagaaacaattgatgcgactaagaaacgttttcctgcttatggtaatgaaaagattatctctttggcagatatagcaatgtacacaaacgattcggaagtacctttgcgtgacgtattgcgttcaataaaagaaaaggaaaatgcagctacggcctctatagatgtgaagaaggctactcccgagcagctacgccaatatttagctgaggttttgcctgattttgatcgtgacagagtgtatgtgaatgatatcaagaaattgatcttatggtacaatattcttgtttctaacggaattacagaatttggtgaagaagctgctgctgaggcggaataaaaattaattctgtttcttttagttaaaagcgcaatatcccttactgaaagggggatattgcgcttttattttttatcgtgcaccaataaacaaaaggctccttaagctgttcttgcataactatataaaatttgcatagaatattttagagaacttatttgtcgtattcagggctttttaattatctttgttgcaatccgtcgatacctgaagagtcagtgttgcgaggaatattacacaaaaagaacaaaagcgtttttaagatattattctgtacttgaaatctggacaatttcactattcaggaataatgcaacgaacgctcatgctctgctgtatatgcaaatatatagtatcgagcgtgggttgttgtacattatttgaatagtggcagtccagagcctcaggtacgataattgcaacgttcccacgcttttttatatacgaaagattctttcgagggaaccgggagtgataggagagaaggaaagagcatgaaagcaacaagagatagcggtatctgtatgaaactggacgattctaccggagttttgtctttggaacgtctggaagttaatacaatggtatacctgtatagtgagcagggtgagttaatagggaagattcactcaacgggagattgtgttacttttatattgccgagaagaggcatgtatgtgcttgttattcattgtgcatcctatccggtggaggtcaggaggatcacttattgaactttcaagaaagagaaaagccggtataccataaggcataccggcagatcgctatagtttatagattctcaattctttagttacgaaaaaccaatccgtcaccttgtgcatctacaataattgctttactacggtctacttcttgtgctaataatttctttgataaatcatttaataaatatctctgaattgctctttttacaggacgtgcaccgaactctggatcataacctacttgtgaaagaaaatctaaagcggcatctgtcagcttcaactctactccattacccgcaagcatcttctgcacactcttgatttgcagctggacaatttgttttatttctttttccgttagtggtagaaacatgatggtttcatcaatacggtttaagaattcggggcgtatggttttctttagcatattcattacctctttcttggtttcttctacaacttcgtctttgttggcactgttcagtttttccatttgactctgtatgtagctactacccatattagaggtcatgatgataattgtatttttgaaatttaccacgcgacctttattgtctgttaaccttccgtcatcaagtacctgtaacaatatattgaatacatccggatgagccttttcgatctcgtcaaacagtactacagaatagggtttacgccgtatggcttctgtcaactgtcctccttcatcgtatcccacgtatcccggaggtgctccaactaaacgtgaaacactatgtttctcttgatattcactcatatcaatacgggtcatcattgtttcatcatcaaaaagaaactctgcgagtgctttagccagttcggttttacctactccggtagtgcccaggaagatgaaggaaccaatcggacgcttgggatcctgcaatcctgcgcggctgcggcgtacggcatcggatacggctgcaatggcttcatcttgcccaataacacgctgatgtaattcttcttcaagatgaagtaacttgtccttttcactctgcatcattttgcttacgggaattccggtccagcgggatactacatcggcgatatcttcagcatctacctcttcctttatcatagctgtatccccttgcatttcatgtagctttttctgggtatcctcaatttccttattcaattcttgtaattttccatatcggatttctgcaactttcccatagtttccttcacgttcggccttgtcagcttcaaatttaagattttcgatttcaactttgttctgctggattatatccatcagacttttttcactttgccattttgctttgtatgatttctcctgttctttcagttcggccaattctttgccgattgtttgtaatttcggttcatcattttcgcgtttaatggcttcccgttcgatctctaactgtttgattttacgtgatatttcatccaatccttccgggacggaatctacctccatacggagtttggctgccgcctcatccatgaggtcaattgctttatccggtaaaaaacgatcagtgatatatcgactgcttaattctacggcagctatgattgcatcgtctttgatacgtacatggtgatgattttcatatcgttctttcagaccacgcagaatggatattgtactcagattatccggctcatctacttgtactatctggaaacggcgttccaaagctttgtctttctcaaaatacttctggtattcatcaagggtcgtagcaccgatggaacgtaactctccacgggcaagtgcaggtttcaggatattagctgcatccatggcaccttctcccttcccggctcctaccaatgtatggatctcatcgatgaagagtatgatgttaccttcagattttttcacttcattcactacggatttaagccgctcttcaaactctcctttgtatttggctcctgcaaccagtgcccccatatccagagagtatacttgtttatctttcaggttttcaggaacatctccccggaggatacggtgtgccagtccttcaactattgctgttttaccggtacccggttcacctattaatatagggttatttttggtgcgtcgactcagaatctgaagtacacgccgaatttcttcgtcacgtccgatcaccggatcgagtttgccgctacgagcggcttcgttcaggtttatggcgtatttttccagtgattgataattatcttcactggactgagaagtgactttttctccttttctcaattcattaatagctccgcgtagttctttttcggtcattcctgcatctttcagaatagtagatacagtactctttaccgttagtaatgccagtaataagtgttccagtgaaacaaattcatcacccatttctttggaatactgtgttgctttctggaagacttcgtttgcttcccgactcaaataaggctctccgcccgaaacttttgggaaagagtcaatttgcttgtcgagtacaagggcgatttgctggccgttcaatcctaacttctggaagatgaagttagtaacattttcgcctaccttcatcactccatacaggatatgagctgtttcaatggcttgttgtccccggctttgtgccagattgatcgcttcttgtacagcttcctgtgatttaatggtaaaattgttgaaattcatatcgtttattctcctttctttttcttattttcaataacactattgaaggcgcaaaagatttgccatgggttaaaaactgactttttttcagctttttaaggaatgtaaaagccaaaatgtcatatattttcctttttacaaggaaattgtgtccgaatgcaagggcattttagaagtatgttgtatctttatagcctgaatataattataaaggaattactatatggacgaaaaaataaagttcccttcgaatgtgatattgatagatgcagcgttcttgaatttagttataacggatctgaagaaatattttgagcgaacattgaagcgtgagttacaagagattgatctttcggaattgataacttatttagcgttagactcaggcataacagaaggagaaaatcaagttcaaatattagtggtatacgataagaattccgtccggttatctaattgtgtaccgtctgatttatctacagagctgaatggtgtagcgtttaagagtcagtttggagaattttcttttgccggtgtgccttgtgaggaaatggtatcccgtgaggaattatatctcgatttattaaatattgttgcagattctgccgatgtgagacaattgattttagtctcttttaatgaagaatatggtgataaagtaatgaatcggttgaaaaagattaaaaataaaaaaacgattcagtttcgtatgaatgaaccggaggaaatgctggaagggcatcaatgggaaatgcttgcatatccgttgatgcaagcgttgggaatcaggggagaagaattgtaatatagacaataaacctttatatttatgtctgattttcgtctaaaagtatttttaagtgttgctaagaaccttagtttcacgaaagcgtcacaggagttgtttgtcagtcagcctgctataaccaagcatattcaggaattggaaacttgctatcggcccgcttgtttgacaggcaagggaataagatttctttgacagaggcagggaagcttttgcaagaacatagtgaaaagatattggaggattataaacggctggaatatgaaatgcatttactccataatgaatatataggtgatttaaagttaggtgccagtactacaattgcgcaatatgtgcttcctcctttattggctaattttatagcaaaatttcctcaggtgaatctttctttgctgaatgggaattccagagaaatagaagcagctttgcaggaacaccgcattgacttaggtttagtggagggaatttctcgtttgccgaatcttaaatatactacgtttttgcaggatgaattggtggctgttgtccacacaggtaataagctctcattaccggatgaaattactccggaagatttatccagaattcctcttgtgcttcgtgagagaggttcgggtacgttggatgtttttgaaagagctttgtccggacataatataaagttatcatctttgaatgtgcttttatatttgggtagtacggagagtatcaaattatttctggaacatacagattgtatgggaattgtttctatccgttccatcagtcgtgaattactttccggtactttccgggttatcgaaatcaaaggcatgcctatgttgcgtgaattctgttttgcccaaccccaagggcaggagagtggattgtcacaggttttgatgcagtttgccatgcatcataataaaaagttataaagcataattagatgcaattggcatataccgataagtagccgtatctttgcacccgaaaaataaaaaagataataagatatggtatcagctattacgaaaacgttacagacaaacaataaaaaggtctatgtttctttactttctattttgactttatttctaatgttggattatgttccaggattgcaggcactttctgcatgggtaaccccaccattagctctcttccttgggttagctttcgcattgacatgtggacaggcgcatccgaaatttaataaaaagacatccaaatatttgttgcaatactctgttgtcggattaggttttggtatgaatttgcattcggcacttgcttccggtaaagaaggaatggagtttactattatttcagtaatcggtacactgatcattgggtggtttattggtcgtaagttcctgaaggtagatcgtaatacctcttatcttatcagttcgggtacggcgatttgtggtggtagtgccattgctgctgtaggtcctgtagtaaaggcgaatgatagtgaaatgtctgtagcgttggctacaatattcatattaaacgcacttgcactttttatctttccagtaatcggacatgctttaaatatgagtcaacatgagttcggaacttgggctgccattgctattcatgatacaagttctgtggtaggtgccggtgctgcatacggtgaggaggcactaaaagttgctactactattaaattgacccgtgccctttggattattccaatggcatttgctacttcgtttatctttaaaagtaaaggacagaagatcagcattccttggtttatcttcttctttgtattagctatgattgtgaatacctatttgttgggtagtgtgcctgcattgggggcagctatcaatggattggctcgtaaaactttaactatcactatgtttttcatcggggcttctctttcattggatgttgtgaagtccgtaggtatcaaacctttgatacagggagtacttttgtgggcagtgattagtctgagcactttagcatatatttattggtgctgattaaatataaacagaactgtatgtaagaggtacgatgtatttagacatcgtacctcttacatataataaatatcctatatcatttactctatacttatgttttttagttctttcccaaggttttttagttcgtcattcaaagcgtttaattcttcactataatttgtatctatagtgttcaaattataagttccgcttaattctatcatacctttttgtttgcttatatctttcttgctgtcataaatgacaggtgtattattggtatagagcctatcttctgatattataaagcactgactggtattttgatacaacattagttttttgatatcatccgtcgtcatatctccttccatatatacaaattttagggaagatgctccgtccattaccataattagttcttttatcttacttcctttacgatttacatagatttctgaaccggaagttgtccctttttgtttcatcaacagttcatatttggatgactgcaccaaagaacgaatatctttagccatctcttcacgtaccttattatcacgcgtagaaaggacctgaacagaattcaagtgttctgccaccttacctatataaaggtccttcataaataagttcggatttagttccatcattgctttagagatgtaaactgatgatacccctttcatgtcgttgtatttgttgaacagattcttttgtgcctgacaaaagagaggtgataatagcagcacacaaaccagaataaatttcattgttttcataaccgtttatttttttatttcgttttttacttcttgatgtattcttctcatgtcaatttggctttccttcacttcattgaacccgttgttcaggttaacggaaatctccagtaatgtcgcctgaaacattcgataggcttcttccgggtcagaaaacgtgtcttgcggtgtaggtggacacacattcttacccagattgtcgataccatatccaagaccgacaagtaataatatagtggctgctatacttccaatccagcgccaattgttcttggaactgttggggcggaagaagcgttgttctttctcggccatttcatcaatcaacaagtttagtttgtcctccaaatatgcaggaatttccacatcatgatctgcgtttaagtaaaggttaagaaagatttctttgtccttcagcagatgttcgggcacttccgttgttctgaaataatctctcagcgcctcttcctggctctcggtagtagtcccctcataaaacttggcgagcaacctttcaatttcttcgactttcataattattccatttattaaattcttcacgtatctttttccttgctcgtgatagcagtacacgaacattaatagaattcaatccggtaacttgttctatctcttcgtaagaacagcctttgatatcacgcatgtttatgatccgttgctgctgttcgggtaagtgggctatgatatcttttacctgtcgtgcgccttcgcgtacttccaggttgtccgactgggaaatatcctgaacggcagacagttctacggtttgtcgggacaatatgtactttcctgagcggagcaaatcaaaacacatattctttaccaaagtgacactaaatgcttccggattactaataacagtcagtccctcccgcttatcccacagcttcaggtaggcttcttgcactatatcctccgcatcggctgaattctccagtagtcggtaagctacacggtacagtttgcggtgataaggcagaaactcttttttaaaactctcagcatccatggattcgtttttgtcaatgtttatatttgtaagacgtaacgggacgaattatgttacaaagaaagagaaaaaagagcaagtaatatgaagatatttgatgaaaaggatgtacttttaatgacttaattaaaatgaaatactatgagtgaaagtgaaattacgaaattggatattattgtagaggtattaggtgagagagaaccagagatacggcgcttggttacattggatgatcggataaggacatttgcagagtctggtgatgaaaatggtcagagaatgccaattgaacttatagcggagtgggcgatgttactggataagtactatccgttggcattggaaaaacggaattctctgaattgatatatgataaacgattggctgtcattcaatgaaatacagccaatcgttatctattgattagagttatttgtgttctctcaatttttcgaagattaatccttccagttcttcagcgagttcaggattatcggcaatacactgtttagctgcatcgcgaccttgtcccagcttcgtgtcattatagctataccatgaaccacttttcttgatgattcccaaatcggctcccagatcaataatctctccagaatgtgatataccttcgccaaacatgatatcgaattctgctttacggaaaggaggggctactttgttcttcacaaccttgacctttgtttgtttaccaatcacttcttcaccgtcttttatttgttgtgaaccgcggatatccaaacgtaccgaagcatagaacttcaatgcattgccaccggttgttgtttcgggattaccgaacattacaccgattttctcacgcaattggttgatgaaaacacaagtcgtacgggttttactcactgctgatgtcaacttgcgtaatgcctgagacattaatcgagcctgcaaacctactttattgtcgcccatgtctccttctatttctgctttcggagtcaaggcggctacggagtccactacgatgatgtcgatggctgaagagcggatcaattgctctgcaatttccagtgcctgttctccgttatccggttgagagataaatagattatctacatccactcccagcttggccgcataaaaacggtcaaaggcatgttcagcatcaatgaaagcggcaattccaccggctttttgtgcttctgcaatggcgtggatcgccagtgtggttttaccggatgattccggaccataaatttcaattattcttccgcggggataaccgcctacgcctaatgctgcattcagtgcaatcgaacctgtaggaattacttctacttgttctaccacttcttcacccattttcatgatagaacctttaccgaagcttttctctatcttgtccatggcagcctgtaaggcttttaatttttcgcttgatgccattttattattatctgtttcaaaatttaactcgtcttctttctttgccataatgatcgatttataaaatttgtgaagcgtgttctttggtctttacctctttcggacggatgattcgttcaacgactccttcttcattgatcaggaaagtagtgcgtaaagtacccatataggcacggccatatagctttttttctccccatactccaaattgctctactaattttttatcagtatcggcaatcaaggtaaatggcagattattcttttcaataaatttttgatgtgacttttcattgtctacactaacaccgatcacttcgtatccggccttacgcaattctgcgtaattgtcacgcaggctgcaagcctgagccgtacagccggaagtgctatctttggggtagaaataaaggacgatttttcttcctttatagttgctgaggcgtacctcttctcccttttcattgatacccagcaattcaggggctttatctcctatattcatctttgatgattttcccaatgtataaattatgtcaatcagcttaccacaaggtggcatatagccaattgacatattattatgttaattacaattccaggtttccgtcgaattcttcgtgccaaggcagaccttgtttgttcaattgttccatgaacggatccggattaaactcttccacattattcacacccggtcgcttccattcgcctttgaagaacatcatggcaccaatcatggccgggacacctgtggtatagcttactccctgcatacccgtttctttgtatgctgcttcgtgactacagttattgtatacatagtaggtacgttctttgccatcttttaagccacggatgcggcaaccgatagaggtttccccttcgtaattttcacccagatcttgaggattaggtagcacggccttcaagaattgcaaaggaacaattttttgcccgttgtaatcgatttcgtcgatgcgggccataccgatgttctgaatcacacgtaggtgagtcagatattcctgaccgaatgtcatccagaaacgtgctcgtttgatagttggaaagtgttttacaagtgattctaactcttcgtggtataacaagtatgagtcacgaggacctatattcggataagtcaagtctttatgaatttccaagggtccggtggttacccactgtccgttttcataataacgtccgttttgggtgatttcacggatattgatttccggattgaagtttgtagcaaaagccttgtgatgatttccggcattacaatctactatatccaggtattgaatttcatcgaaataatgtttggcagcatatgccgtataaatgccacttacccctgggtcgaatccacaacctaagatagcagtcagacctgcctctttgaaacgttcgtgataagcccattgccagctatattcaaagtgagcttcgtctttaggctcataattagcggtatccaggtagtttacacctgctttcaggcaggcttccatgatagtcagatcttgataaggcaaagcaacgttaataaccatttccggtttgaagtcgttgaatagtgctaccagttcgtctacattatcagcatccacttgggctgtttttatgctggggttgccgatggctttcacaatgtcgtcacattttgacttcgtgcggctggcgatcatgatatcagtaaatacatcggcattttgtgccactttgtgtgctacaacggtacctacaccgcctgcaccgataataagaactctacccatttctttaattaagaattttaaattaagaatttaagaattgttgatggaacaaatatacggcattatttcagaatattcgccgatttaagtttctttatttggcgcgaagcaagataccattttcaaactccagtatttttcctctgtataaccatgtctcaaaacgagagtcggtccgggctctgatttcgataggttcgccgattgccaacttacactcttcggttgtcatacccggttttacctctccttttgcaagcattaaccagttggcttcgctaatgttcggatatttttttcgtatgttggcaaattcaaaaagattttcgatgaaatcttcatttctaaggatagggtcatatctcaaatctacttttattcggtatgttgttcccaaaacatctgccagtaggagtgtagctgacgttcctgttttttcaggttgcacatctttgatttgtaacggagtataacgcagtaaatctgcttgttttgttcgtattgtttttaagggataaacggcttgtccgatatatttagattggatggactctttggctttaatgtccggattggtaaaagaaaatgcattggggaagtagctcatccttttttctgcttgaaaatcttcaggttccatacaggaatttgttctggacatggctacgtcaatataataggtgttccctttactgtcagtaaaaacaattctcacaggaaaagctttgctaccaatacttattgccataactttcacgggttcgtctttgggaatgctgacctctctgtatccggagtaactgctgacatcatctacttttactatggtagtccgggtataaagtgtttttccaatcaataattctttggcagtatttatatcttgcaggtagacgagcccgttgataccggcacgaggatctttatcacacagatcgtttagtttggtatctttcatttcataatagtattttttaccttcacattcaaaaatgaaacgtgaagtatatattttaccgatatatgtttcatgctctgtttcttctgatcctacatattctacagttttatttttgagtaagtcgttaactacttctttcccgttttcgtaacaataaaatatggggatgaattcgtcaccactatccggaataaacataaattttattccaggtgtccacttacataattgtttcatcggaaaatacgttgttatgaaattcgtttcttcatcaaccgatggagccaagggggaagcgaggggtacggaataatctttctgtgcaattgccgccgaagcgactgtcaagaggaggagtaataaggttctgatacgtcttttcatgattgtatattgtttgttgaactattcgtatgtctgttctgtttatcttaattcgacaaatgtatcaactttatattattttttatctatatttgcgccaatatttaacttaaatagtataacaatgaaaaaagtattgttttcaatttgcatggcaggtgcagcattcgcaatgtcatcttgtggttcaaccaaagagaccgcttctttatcatctttaaatggtgaatggaacattattgaagtgaacggttcagctgttgttccggcagagaatcaggaattgccgtttatcggttttgatacagcaactggaaaagtatatggtaacagcggctgtaatcgtatgatgggttcgatagatctaaattcaaaacccggtactattgatatgagtcgtttgggaagtactcgtatggcttgtcctgatatgacaacggaacaaaatgtactgaatgcattgggacaggtaaagagttataaaaaactgggtaaacagaacatggctctttgtaatgcttccagtcgcccggtggttgtccttcagaagaaagtatctacggtgaagttgtctgcactgagcggtgaatggaaaatagaggaagtgaatggtgagactatcccttccggtatggagaagcagccttttatcagttttgacgttaaaaagaaatctattcatggaaatgccggatgtaatctgattaatgggggatttgaaactgataaagaaaatcctcgttctatttctttcccaaatgttatttctactatgatggcttgtccggacatggaggtagaaagtaaagtgatgaaggctatcaatgaggtgaaatcatttgatgtgttgtccggtggtggaattggtttgtataacgcagacggaacactggtaatggtgttagtgaaaaaatagaagtgccttagttaaaagatacagagaagggtgccctatctgagcaccttgacactttgacaacaggctgtatatcaatagctatttgaggataaaacactgaatccaccgtgtaaccctacacgaacatgatttataatggttttatttcgattgcaaagatatacagtctgttttgatttatatgcttaaaaatgaaaaatttgcaagtaagcctcaacacagtattttatatcctattgtctcatctatgtctggctacataacctagttagattcgggtacaacacgtgtattcgcaaactgataaagatcctgtgccaaaattttggcacaagattcgacgttgagtttttgatctacaatattattttggtttaaaatatcacgaatatttgtatagagatcagtttgcaatagaccattaagatttagtaaactttcttttgctaatgcaatatcttcatttaactttagaaggcactcgttcttatatttatcaagtattaacatcccttctctgtcaatatcagattctgctaattcttttatctgttttgagaatattacaatagatgaaagcactgattgaacctgctggtaatttttaatagccggaataagactatcccatgtttgcatatttaattcatctaatacatttttgtctatttcatgcatataatcaatggttgttatggtgtcttcatctgtcctgtccttgtctgccatactatatattgggaatcggtagcatatcttattgataggattaccgtgaataagaggaataaatagaacctcttcaaaattactctctatcacaattcgtttaagactaaaataatcggattcaagtatctctcttaaggcacagaacgcaatactcatatccttgtctaaattgtctattgagacatcataggctataagtaatttaccatcaccaattttgtatttcaaattttgtttgtgatgcttaatttttgcgaaaacttgaaatattttattttcaaaatctttttttattttcccaattttatcactagctattttttgcaatttaaaatttgacgatttgttattggcaaaaacagtccaacagtttaggataacaactaagtttgcatgttccttgattgagagactttctatctcttttgattcataatactttttgaatttatcatttatttctttgacaaacttaggtcttactaataaagcatctttaagatgcatatatggcagattgctattatattcgacaaattgtccttgattaatcttagcaatattgacaatattgtgctcaaactgatcaacgaaatttttgatagcgttaaaatatcttgattgatagtcgatgtaattgacataattagctgcaattgaaaatctgctaacaatctcacaataagcaactttatctttttgggggttactcttgtcttgttctttttcataaccccatctatcactaattgatttaggaagtgctatccgtgtatcctgcttaaccacatcacctaatttctcgcagaaaggtataaactttctgatgtcagatgttttaaagtattcaataaaagtatcaactaatgaatccatcaggtcacaataattccgcctgaattctaatacacatttagtatactcattccatgtgttcactcttttagtgtaatcataaaggtttattatcaattgattgatctgaacaagatgatttatcggtagattgtttttgctaatatgtttcaatgaaggatcataatcatcattgtttaggatatattgatcgaaacaattcataccaacacatcgtgcattatattgtttgcaattaggataaatctttctcagtaattcaagtatacgtacagaggtatcatttaaaatattggaagggccacccaactctttcgaatttacatcaaaccgaactaaattatatacatatatacaatctatattaccattaatgttgagataagaaattgtatatttctctctcaactttttaattgcaaactctcttagagaagagatgatttctttagaatatccataggactctaatccaaaaataagttcagaaatatcttctattgaagtattagtattattggcaatcttaattaactcaggattattaataatgattttgttgtttgttaaacccaaatgaccagcccaaaaacagtatatcccaatggctgaaatatccgcattacttgcaatatcaatggtctgccctcccaaatatgacaaccattgtttggcatattgatatacatcatccttaggagagaacttttgagacagctcatcaaaaaaaactaaaatttcaggattcatttttttgaagatactcctcatagagttatatatagtcccatccattgttcccgaatagtcatagggaagtcctatgaaccacccgctattcagttttttatataatccctcaaacaacagataattgtcaacgaatacaaaatcatatacacctttccataataaggctttaagtatattcgcaacacctacccaagaaaagtgtaaatcattacgtttaatctctttaaataaagagattacatcatagttattatcgaagctatttaatagaaaactatgcaaatccgactcgttaactaatgagattaatgcgttgatatagtctgttttattaataaatttattttcgtcaaataatatttcacacaaaatctccgaccgaacataatgcattccagatagatacattgaatcttcaatatgttctaataaatactctttctccaaatttgtaatataagattgagctaacacactatcgagtccaagtttatctattaattttttgcaattaacttttgaattgtaaagatcggccaaacatacatatcttaagattttaagttcagttatcttctggtcggtttccaatctcaaaacttgatttcccaacttattttttaatttatctccatgattcagaaaatacatatactcaagtaacaatcccttattcccaaagcgcatccatgactcctcaaaactggcatttattaaatctttttcgtttttcgagatactattatatagtgatcgtgcttcttctttgtcaaatattaattcaatatctttaaagctgtaatcttctccgagtaacgttttattccatgtttcttgtcttaaagtgattaagaacattagattggatttattcgagaattctttgactacctcattccaatgattgttatcaggtagaacatcaatataaatgattactggaatatttaaccctttacataatccatctaatgaatttatcgtatctcgaacatcattaaaattcgaagatagcttcaattcaaacatagttccatcaatataattgttggacaagtatctatatgctaacgaacttttcccttgtcctgatgcaccatgtacaaaaacaatattatttgttgcaaatgctttgtttatctcattcagtttatcatatcttattacatctaatccagctagaatatgttcatatttagctgaaatacctgaaatataaccttcttttaataattgaatattatcgctatcaatattttttacctgcaatggaatgattgttgagccatattgagaatgaaatttaattctttcctgtacgaatattcctattcgttgtatttcttgaagaagtgttattcgagtgacaggaatttgtttttcagccgaaaaacatatccatgataggagtaattcaacagcaataacagggtcaataaatggatgttccgttttaagtttaccaactatatcattatacaatgatttttcactcacaagcattggttttgtgtaatgtgccagtatagtttgaattttattatcatggaaccctttagattttaatttttgacctaacttctttttatcacttagttcatcacttacagagccaaaagaaatgactttcgctattacattaggattagtgcttgacacctgaattattcttttaaaaaacgaatctttagctgaaaataaatccgaaaaagttagtgaatctgataggtttttaacttgaagacattctacatactttccattgttatctattatatcaaggtcttcaaattctccctcgatatgatagacgtaatcatcagttacaccaaaaacaatccgatgtagtgagtataaaaattgcgttctgtatccttttaatgctgctattgcactcatatggcattctattttttttataaagttaacataaaattcaataccctcaaagcaaaatcgttacgaactaaaaaatatcattcatcttccctttcattttctccttatcagagatagtgtagtagtgccgatagatagtttgtggagagtttcctgcaagttctgcgacttggagtggatgaaaaccttcgtctatcatcttggagatataactactgcgagcagttccccaagtaactcgtgatttgatgctgcagcggtcgcaaatcttttgtaatgtttcattaaccttctcgtttattcgtttaactcgtccgtaaagtttctgttgagttggattgcatcgcttgatggtcggaaagacgtaattcatataagcttcggtgcgatagcgttcgataatatctgctgctttgtcgatgatgatgactcgtgcctgcttgtcatacttagtacgctcatagataatctgatcgtctttgatttgatctcgggtaagtaaacaaacatcaatagcagacattcctccggcatagtagctaaacaaaaacaggtcgaggtagaattgttccttcttggtaagcaacattcggtcgaaagactctatctgttgcatcacttctggtgatactccttttggggtagtaatgcgatgttttagcttctccttaaatgaaccaaaagcgttaagattcacgttgtacactccttgctctttagcgtatagacagactgccttcaattttcgaagtttaccactgacatcaccagtgtttcccctctttgctgccctcacttgtatccacactacaaaatcttgaaggaatttctctgttaggtcgcgaaacctatacttcgtaaaatcccgatgatacttacttcgagtaaattcttgcaacgaggtgtttagatagcgatactttcgtgatgtagataggcttttaagtacacgactatttttatatcgttcctgattatcgaatttcgtcgccaattcttcaataacatccgagattggaatatatttgtttcggtagtttggatcagtatcataatagtgagatagctccacgggaatccaatccttaccttgggcatcccagcgctcgccaactttgaggtatttaagtttctgttgctggagaaacttaagacttaagtatttgtattttaacaacttagtgactactagatgtatatgtaaaaaaaaggtgggtccctaaaggagacaccctttttatttttattcacctcatttttagatatacaaagaagcgggttgtttttgctcgaattactaacttttatttcataggtaaaatcggtgcaattagtatttgtacaatgtatactacttgtcataatcctgacacactttttcgtagtgacggagtacggtttcgattgagcaacctagatactgtgctaccttttcatacggcacttcgtttaaaagtaaatgtttaatgaatatagacttcgtcattcccatcgtaatcacattctcaagtttaagcatctttgaaacctttctcaacgtctggttggtcagctccgagattcgcttgattcttccgagttgttgttcgggaaagttgtgcttatgggtaaagatgggaagcaaatagtcgtcgaaacacatcggctgatatttgtcgatgatatgtaatgtgtcagaacacaaaggaataacagctatattctcagacgaattccgcttgcaatacaaatatcctttcttgatggaggatattttaagcgacgccatctcatttattgtcgagccgccagtataatatccaaataggaacaggtcaatataaaattcttccttctctgtgagtttagcccggttcataaactctatccgttcaattgcgatataatccaccgataaaggttcttcttctaactttaccggaatttttacactttcaaaaaccgaggtgtcggcattagcctctcggaatactcgacggagtttttgcaatttattctcgacattgcatccattcaagtggttgatgtacttttgaagaaagcgcgtgtcaatatcatcaaaggtcagtgtcttgaaatctcgtttcattacagtttgggtgaaattgcacagacaattccggacataccgaaattttcgttcgttttgagagccagtaattatctgacagtttctttccctttcaatttgcgacaggtatagtaatagcttctcaaaagcttgtgatacattttttctcataacagatgttttttagtgatgaatattctaccgattttgcatcggtatataaaagaatagggtgtctgaacggaaaaggtttgtcgagacggaaaattattcaccgaaaatcgagttcatctctttgagcatctcatccgtcttggtattcttgtaatagtgtttgtagatcaccatcggactattgcctgccatctcggccacaacatatggagaataaccttgatctaccatgcgggtaatgaaactggcacgggctgagtaccacgtcagtttgtctttgatctttagcaaccggcaagctttggcaagcgtcaaggtcatcttaaccgtaaggttactgattctcttcgttcgctgcatatctgtcttgtgcttgtgagtgaagactggaaaaatataattctcaaatccagtaccacgatacttctcgattatctttttcgccttttcaattaaaagtggtttggcttgtttgggaaacttcatgcgctcatagatgattttatcctctttgatgcagtcccaagtcagatggcagacatccacattggccatacctccggtatagtagctaaatagaaatagatcaaggtgcaattgttctttctgcgagaaaaggcttctatcgacagcttccagtttctccaaaaccatgtgagatgttgctttagaggtggttggttcccatttgatattatcacccaagcattcgaatgctttcatatccactccatagatgcattgtttctcagcataacggcaggtggcgcgcagacggcggagtttttgagtcaaacctcctttgtttccgtttttaatacctactttctgaatatagagagtgtaatcaagcagaaaacgttcattgatctctttgaaatagtaagaggagaaagaacgattatagacctcctgtgtgaatcgagtcagtgaatttttgatctctttgtaacaacgggtattattaatgcttgtgatgatccgcccatttttatatcgctctttatgagtaaacttttcgattagagaatcgatcatttgaataacagagagcgattttatctcttctttgcgagtttgaacttcattgaaacagtgagacagttcgactggtgaccaaactcgcccctcataatcccagtcctcagcgactgtttggtactggttcttgagttcgaacaagattttgttcttagcagtaagggtactgccattgcctttaaaggcttgggattgattatcccagtccttgaccggaccggaaacattgagcactttggttactcttgcataacctgttttgaagataatcatttcgagtttgaccatcttcgggtctttagggtttgctttccctttgatgttgatcgtaaacataaaaatagagtttagcattcgtacggattattgctccggtagtcaaaagacccactagagcagactacatcagaatagtgcttccctcctcaaaaggtttaaatcactctaaatccataaatgcgaatctctatcaacatccataaaaacagagacttacatcagctattgatgtaagtctcgtaaagtaaggcttcctgcaaagggcacccttctctgtatcttttaactaaggtttagtataataatggttcttcttattttagatatgagttgcggagtatgatccaaacgattactggagagccaaacaaagcagttactgcattgataggtaatgtaccctgcattccgggcatttgagaaattaagtcgcaaattaacagcgtaatggcaccacacagtatggagcccggaagaataatacggtgattagggctcccaaacaatcctctggctacatggggcatggtgatgcctatgaaggctataggaccggtaaaagctgtcgaagttccggccaaaagtgcagtggccagaataatccagaggcgtaatctggtcacagagactcccaatccgttggcatagttttttcccaacaacaagatattgagttgtttttgcaagagcaatgcagtcagaattccacaggcaatgacgggggccatcacactcatctgttcccagcccactgaagagaggctgccaaaggtccaggtaataaaaagcttgagagtatccggattgctcatgctttgcaggatactgacgatggcaccggcaaagttgccgaacatcatgcctatgattaacagggagacagtctgaggtattttgatagaaacgattattgccaataataaaactcctatagccccaatgatagcagctgtcacttgcccccatcctgctataagccacaaaggaagcgaagaagtgcctaaagtgagtaaggctactcccaggctggcgccggaagttactcccaatacatcaggaccggccagtgggttatgaaacagagtttgcatcaatactccggcaacagaaagtgatgctcctgctaaaatagctgttaatgctttgggaagtcggtgattgatgataatttcacgatagataagattatcactgcctccggtaagtgtatcccatacgtctcgtatggagaggttgacgctcccaatagcaatatctgccatgaaagcaatgactaacaatatgattaataataaaaacagccggtagtttttcattcacttcttaatttatccatgtaagttaactcgtagtcaggcaatagtgtcggatgaacgatcttgatcatatcactcaataatagatctggacgagctactccactttcccaatagtcgtttccaccagtagcatttgtccgcttgtttatatggtatacattgccgtctttatatgatttgaatagtttgtatttcgagtccattcgtcccaactcttccaaagtattggcttgtacgcctacccatatgtcagcttggttgaaatgtatcagagcttcttcaatactgctggatatactaccggaagctgttgtgtcgttggcataatagtaattggcacctgcatcgcggaagagttgtgcactatagcttcttcctcccggcatagaccaggttcccctgtaatcttgcccggaaagtatagaaggcgcatatgaaaatttctcggcactcttttttacttcattgtattgttttgctatttgcccgaaaatgctgtcagccaatgcttctttgtcaaaaagggctccgacaaatttaatccattctgcacgtcccagaatagatttttcttgccattcaatattatataggatcggcaatcccgtttgtttcatacgtcggctgttttcgtcttcggtattgtaggcagaagtcattacggcctgtgggtgtaataaaagtaagttttctatgtccagattgaaagcatcgcccaaatcttttattttaccctctttgacaccttgcagaatggtaggattgtaaatataggccgagttgcacacccctgtcactttatgcaattcccccagaagttcaagaaaccccaaatgagtagctgagttggtcataatactttttagtgggatcactattttgtgaccgttggcagggacaggctgatcttcggttttcacaagataatagatatcataggtctctcccggtttccagggattatatactgttactgtagtgtattcaggagaatgtgttattccgaatccttctgcatatgaaagaggggtcggaacaccttcttcgacagtgagtgttgctttctgcttttctttgcaagcagtgagcagaaatgatattagtacaaaaagaataaaagaagatcggttcatcatactttaaatattgattagtcgtggtgcaaaaatacaggattattccggattataggtctgcctaataaggaaaatgccgtaaatacgagcaaagggaaagctgatgaaaatgtgtttttaaacgtacgtttaaaaacacattaaaaacaagtgattcgttaaagggaaagatttataaaatcatagagataaaatgaaaagaaaaagaacagacattgatttgagaatgaggttatttcaataataatgaaagttaaaaggaagtctttttattaaacactttgtgtatttaaatattagctttatctttgtgaacaaataaacgtacgtttaaaaacacatttttttagatgtaatacattgataataagaatgttttgttgagaatatattaaaagctaactactatgattttattaggattgattcttggaagtgtaatattgggactgcttgcttgtctgatatggatactttatgattttcggagatttaagaagaaaaataatcttatagaataacttaggaaaatgggcaagaaagtattagtctttttactgtttcttttatttattggatgggtaagggctcaacaggaagagctgcaaaaagtagtaggacagagcaaacaaactcaggtttttggacgcaatatatttgcaagtcggaacttatcatttgaacctaatctgaatattcctaccccggaaaattatatgttaggaccgggggatgaagtgataattgatatatggggaacttcggaaaatacggtaagagagactatctctcccgaaggaagtattgtggtggagaacatcggtcctatttatctgagtggtatgaacatgcaagaggctgagcggcatttacgacgtgagttcagtaaaatctatgcagctatttccggagaatcggtacatatcaaggtgacattagggaagatacgttccattatggtcaatgtcatgggggaggttgaagttcccggtacctatcggttatctgcttttgcatcagtgtttcatgctttgtatcgggccggaggggtcaatcgaattggcagcttgcgtacgattcaagtcgtgcggaacggtgaaaaggtagctgatgtggatgtatataaatatataatggagggaaaactggcagatgatatccgtttgtcggaaggagatgtgattctggtctctccttatgagaatctggtcggtattttaggaaaagtgaaacgaccgatgatttatgagatgaaacagggagagtctctggctgccttaatcaactatgcaggcggctttacaggggatgcttatcggaatacggttcgtttattgcgtcgtagcggaagagagaagcaaatatataatgtagataaagtggattatgaaaactttattctgactgatgatgatgaaatttccgtagaggcggtattagatcgtttctctaataaagtggaagttcgtggggcagtatatcgtgccggtatgtatcaactggacagtttgacaggaactataaaacaactgatatgtcaggccgaagggcttcgtggggatgcttttcttaatagagcgttgcttaagcgagagcgtgaggatctgtcacatgaaatgattcctgttgatttgaggaaactgatggaggggagtattcctgatttatcccttcaaaaaaatgatgtactctatatttcgagtatccgggaactggaaaaggaaggaacattggctatctatggcgatgtggcaaatccgggacattttccttttgctaaaaatatgactatccaggatctgattttaaaagcaggtggtctgttggaatcagcttcaacggttcgtatcgatgtatcgcggcgtattaaagatgctaaaagcacctcttcctcttctgtaatagggaaaagttttacggttgaattggagaatggcctattgataggagcaaagagggtgtttgaattggaaccttatgatatggtttttatacgtagaagcccgggctatcagaaacaggcgaatgtgacggttgatggagaagtaatattcacaggcaactatgcgctgactaaaaggaatgaacggttgagtgatctgatagctaaggccggaggattgtcgaaagatgcctatgtaaaaggtgcacgcctgatgcgtaggatgacagctgatgaaatccggcaaaaacaagatgcagtccggtttgctgttaagggaaccggaaaagattcggtatctttggctgctctggaagtcgatcagacttattcagtaggtattgaacttgaaaaagcattagcaaaaccaaagtccgatgaagatttggtgttgcgtgagggagatgtactttttattcctaaatatgtcagtactgtgaccataaccggagctgtgatgtatcccaatacggttctttatcaaaaaggaagtggaattgattattatataggtcaagccggcggctttggcaaccgggccttgaagcgacgtgcctatgttgtatatatgaatggcactgtttcccgattaagacacaatacggcaaatgccattgagcccgggtgtgaaataatcgttcccactaaagaagaacggaaaaaagctactgtgtccggagcagtaggcatgagtagttccatggcttctattgctgcaatggttgcttctatggtgagtttaacaaaataagagatagatgaatataaatgaaaagcccgaaatggcggagaaacagtcatgtcattggtatcttgcttttacagcttcgcgggcagagcaacgtgtaaaacaagaattggatcaacgaaaagtacggaattatcttccattgcggaaaattacttatcaatggcagggccgtcccaaggaaacattgttaccacagataactcgttgcattcttatctgggcttcagaatctgatgttttgcagttgtccggaatacaaggattaattattcctcaaaatatatgggaatatcggataccggaatggcaggtgaacagttatcaattattgttttctcatatagatactgctgtggagtggatacctgattgtccggagccggctcctatggttcgtgtcaccggaggttctttaaatggactggtgggcgaactcgatacttcggaaacagaaatacggataataatccgttttcatactatgggatgttttcgcataaccatacctggagagtggattgaaaggttttagatattactttctcttttttcatctcaacgataattcctcgtccgtttcagggcggggaattattattttatttccctgtaactttgactttttttcatcctttgggtgacatgaaaatgtcaaaatctgactttctgtcagaatcctgtcactttcgatcttactcaaccttttggcacaaggtttgtttttttatagtcgtccgtttgagacaaactcctgaagggggtgcgggaataaccggacaaaagaaactgaaataataataaataaaagaataacgatcatgggaaaaattattggtattgacttaggaactacaaactcttgtgtttctgtatttgaaggaaacgaacctgtagtaatagcaaatagtgagggtaaacgtacaactccctccattgtagcatttgtagatggtggcgaacgtaaagtgggtgatcctgcaaaacgtcaggctatcacgaatcctacccgtacagttttctctatcaaacgttttatgggtgaaaattgggatcaggtgcagaaagaaatcgcacgtgtaccttataaagtggtgaaaggtgataataatactccgcgtgtagatatagacggacgcttatatactccgcaggaaatttcagcaatgattctgcagaagatgaagaagacagctgaggattacctgggacaagaagtaacagaagcagtaatcactgttcctgcatatttctctgactcacagcgtcaggccacaaaagaagccggacagattgccggtctggaagtgaaacgtattgtaaacgaaccgacagcagctgcgttggcttatggtctcgacaaggctcacaaagatatgaagattgccgtattcgacttaggtggtggtacattcgatatctctattctggaattcggcggtggcgtatttgaagtactttctacaaacggtgatactcacttgggtggtgatgactttgaccaggtaattatcgactggttggttcaggaatttaagaatgacgaaggtgctgacctgactcaggatccgatggctatgcagcgtttgaaagaagcagctgaaaaagctaaaattgagctgtcttcttctacaagtactgaaatcaacttgccgtatatcatgccggtaggtggtgtacctaagcacttggttaagactctgactcgtgctaaatttgaatctttggctcacaatctgattcaggcttgtcttgaaccttgtaagaaagcaatgcaagatgctggtttgagtaactcagatattgatgaagtaattcttgtaggtggttcttcacgtattccggctgtacagaagttggttgaagatttcttcggtaaaactccttcaaagggtgttaatccggatgaggtagtagctgtaggtgccgctgttcaaggtgctgtactgactgacgaaatcaaaggtgtggtattgttggatgtaactccgttgtcaatgggtatcgaaactctgggtggtgtgatgactaaattgattgacgctaatactacgattcctgcacgtaagagcgaaacattctctactgctgccgacaatcagaccgaggttaccatccatgttttgcaaggtgagcgtcctatggctgcacagaacaaatcaatcggtcagttcaacctgactggcattgctccggcacgccgtggtgttcctcagatcgaggttacatttgatattgacgccaacggtatcttgaaagtatctgctaaagataaagctacaggtaaggaacaggctatccgtatcgaggcttccagcggtttgagcaaagaagagatcgaaaagatgaaagcagaagctgaggctaatgcagaagcagataagaaagaacgtgagaagatcgacaagttgaatcaggctgacagtttaatcttccagactgaaactcagttgaaggaactgggtgataagttgccggcagataagaaagccccgatcgaaacagctcttcagaaactgaaagatgctcacaaggctcaggatatggcaactatcgatagcgctatggccgaactgaatactgcattccaggctgcaagtgctgaaatgtacgctcagagcggtgcgcaaggtggtgcacaggctggtccggatatgaacgcaggtcaggctaatcccggacaaaataacggcaaacaagacgataacgttcaggatgctgactttgaggaagtcaaatgattccgataaggatacagataataaacaataagcaaaagcgtgcagctcaatgagttgcacgctttttgcgtttatggagttcatggttgctatgtgttttctatgggcttttttatctcttatttgcgacatgtttgcgacaagacaaaaaagtagataatgtggtacttaatcacacttatacatactaatacatacttaaaagtagataacatgccaacaatcggatttgaaatcaaacggaagtgtaaggtctgcggcaaagtgtttgtcgcaaaaacacttgacagtcactattgttcccctaaatgtggtaaagtggcttggaaacgcaaaaaggatgcaaaggatagaaacgcgaagttagaagccattgctaaacaagtatcagacatcagagagtacatttctgtaaaggaagccgtcgctatgttcggggtggaacgtagcactctgtatcgcctgattaaattgggacgtattccaactatcaatatgggtacaaggctcacacgtatcaaacgctctgaaatggaatggctttttctaaacagaccggaaagtattgcggagaaagaaaagcctgctcctaaaatatacagcttagagccggaggattgctataccattactgagatttgtgagaagtaccatattaatgacagttcagtatgggcacatgttagaaaatactctattccctcaagacaaataggaaactatgtgtatgtacccaagcaagaaattgataatctatataagtcagaagtagaatgaagaaagcattacctaataccaaagtgaccgtcaaactcagaaggtcgaattataaagaagagtggtatctgattatagaatcatacccagtttataagcgaggttctaaacgggcaagccgtgtggtggaatccattaaccggactatatccacgcctgtttgggacaaatcgtccattgcacgtattttgccagatggaacattcaactataagcctaagcgtgatttgaatgggattatccaatgccgttcaacgatagaccaagaggcttgtatctatgctgacaatatccgtaagttacgccaacacgaatacgatagtgccatcctttacactgataaggaaaacgaaatcgctgcacagaatgagcggagcgaacaggattttatcaagtatttcaatggtattataagcacacgtcatcccaatagttccgattcgattatagttaactggaggcgtgtaggcgaattattgaaaatgtattcgcatgggcaaccaattccattcaaggcgatttcagttaaactgcttgaagatataaagatgttccttcttcgtgctccaatgggagggaataagaaaggtactatctcacaaaatacggcatcaacctatttctccatactcaaagccggactgaaacaggcatttattgatgaatatcttacagttgatataagtgcaaaagtaaagggaataacaaacattgagaaaccccgtgttgcacttaccatgaatgaggtgcaaatgttggttgataccccttgcaaggatgatgttttgaaacgtgcgttcttgttctctattctcacaggattgcgccatagtgatattcaatctttgaaatggaaacagattcaacaaacaagtaagggaacatggcaagcggtcgttgtacagcaaaagacaaaaagaccggattacaagcctgtcatccaacaagcacttcaattatgtggcatacgtccaaacgatgatgaagcacttgtttttgaaggactgaccgatgcctcttggatttctcgtcctctgaaagtctggatagaagcatccggtatcaagaagcacatcaccttccattgtgggcgacatagctacgcttcgctgttgctggaaaatggcgttgacatatacacaatcaagtctttgatgggacatacaaacgtcaaaactacgcagatttatacgcatcttgtaaacgaacaaaaggagaaagccgccaatacactgtatatagaaaatttggatttataggttgtggtggttatatccaccattgagcatcaacgacttatgtaataccaatcatatacttaccaccatttgcccctcatgaagcatcggctttttgaggggtgttttgtagcattgagactttcggtgaggaatgtgttagtcccaataatagtttatttcccttttattatgttttccaataaattctcgtattaatgaaacttaaatctgtcagtggtaaatgagcggttgattggtggctttcaagcacctatttagtactcataaacatccctatacttttgcagcatcaactttaatacgaagaaaatggcttataaagtaaattcgttggaggaaatgccaaatgcgttgtcctacctgattgagtccgtagaatcactacaatccaaagtaaatgccttgcaacataagcaggcaagtgattcacccaagtggatggatatagatgagctatgcgcttatctgccatcgcatccagccaagcaaacggtttatggatgggtatcaactaaacagattcccgtacataaaataaataaggcattggctttcttgcaatcggaaatagatgactggttgaagaacaaatcgcataagacacagaatgacttgatggaggaagccagacgatttgtcgaatccaaaaagattatcagatgatgggaacgactgattattgtttttcattctttcgcaagcctatccagaacatcgaaccgataagagctgtaggtattgtggatgtgtaccgctatatcaccgggcattatgcacaaccacaaaccgaagctctacgtctgatgttaacttctcctgaagccaaaaggtacaaaaccacccattttgactattgtactttttctggattattcggtaagcggaatgagaaggaactgataatgcactccagattgatgtgtctggactttgatcatgtggaagatattatggaactaaagcaaaagttactcaaccatgaatatttcgatacggaactgttgtttgtcagtccatccggtaatggattaaaatggatcatacctgtagacttgaaaggctgggaacatttccggtactttaaggctgttgccaactgcatcaaaacaacaggcttgccgttagtagatatgtccggaagtgacgttgctcgttcatgttttttgccacatgatccacaagcatatattaaccctaaatataaagatgatgtcgaagaaaatatttttcgcccaagattgggagaatgtcccttctgaaataaagcaaacagatataccaagtatcacttcattatataataaggtagaggaagatgtggaacatgttgtctgggaaatagagcagcgtgccattgatatagcacccaattataaagattgggtagaattgggttttgcgcttgtggacggattgggagaaaacggacgggagtattatcaccgcattagtaggttttatcttcactatcaaagggaagagacagacaaacaatacacgcattgtctgcaatccaaaggacaaggtattaccattcgttctttcttccatctggcaaaccaagccggaatctcgctggctccattcagcaaagaacatttatccatttttccaaatatccaaaatggaaaaacgggtaaatggataaagtcagaggaagaacttccagcatttcctgagtgtgtatttgcgcatcttccccctttcctaaatgaggttgttaacaattctatatcgctggatgaccgtgatacgatattgattggagctattgtgtgtttgtctgtctgctttcacaatgtttgcggagtttacgatgaacgaatcgtttatccgaatctttatctgtttgttgttgcagatgccggtatggggaaaggtgcgttgactttgtgccgggaacttgtagcccctatcaatcgtaatttgcatgaactttccaaacgattggagcaggagtataaggaagcaataaacgcttacatcaaaggcaagaaagatggtggaatgaccatgccagctgaaccgcccatgcgaatgcttgtcattcctgccaatagtagtgcaagttctttcttgaagatattgggagataatgacggtatcggactactatttgaatcggaaggtgacacattaagccagactttgaagtcggactatggtaattattctgatgtattgcgaaaagcattccaccatgagttagtcagtttaagccgccgcaaggacagggaatattgcgaagtcagcaatccaagagtgtcagtcgctttggcaggaactcccgaacaagtaagaaaattgatacctgatgcagaaaacggtctgatgagccgtttttgtttctatatcattcgcttcaagagaggtataagaaacgtgtttgccacaaatgatatttcccaatccaagaatgccatgttcaaactattgggggataaattctgccatttacatgaagaatttgttaggcaaggtaattattccttttctcttccctctgatttgcaggaacattttatagaatatctcagtcgggtgaatgatgaatgttgtgacgaagtagataacaaaatgcagggtgtagtccgtcggatggggctgattgcctatcgtataatgatggtgttgactgctgtccggcatttggagaatatgcctcacgaatcatattcctctgacgagactatacaattaatttgccataaatatgactattccatagccatgagtatctgtgaaaccttgctttgccatgcagtgttcatctatcgaaacttgtcaggaaatcagcccaaacgtttacaatccctttcacaagaaacgggcatttacgcacgaaggaataccctttataatatgttgcccgaaacatttaccaaaaaagattatgatgcaactgttttagctttaggtgagaatggaagtacggcaaacaaatggatagaagcctttatcaaagatggcaaactaagccgaatagaacaaggtaaatataggaagattttttgagtggcaagtttgtgttttagtgtcactaaaacctaggcggcaagcggatagaactgccactctcaaaaaatcaatttatgcacatcaaagtttagataagtatgaagaaaaagaaacttggtggtcgcccaaagttagcgaattaccagaaacgcacgaaatgtttccgggtaatgtttaccgagaacgactatatctatatccaatccaaagcccaacaggctggactgtctgtcaatgaattttgccatcaggctgcaatgggctgtgaagttggtcagcgtatcagtccggaaatggtatcggcaatccgtgacctttccggtatagccaataatgtcaaccagattgcccatcagatgcacatctatggtttggaagcagtgaaacaacaatgtttttctattatatcagaagtcagtagaattatcacccaagtaaagaataacaatcatgatagcgaagattaaaacaagagccgattttggagggatagtaaattacgccaatgatcaaaagaacaagaaaaagagtgccatacttttagcatacgaaggtgtctgtgccatcagcaataagaccatagccgattcttttcagatacaagcttctatgcgtccgaaagtaaaaagttcggtgaaacacgtatcacttgctttctctccgcaagataccatccgtttttccgatgatgaaaaaggagatacacttatggtggagattgccaagaaatggatggagcagatggggattagcaatacccaatatatcatagccaggcatcatgatacggaacatccacattgccatatagtgttcaatcggatagataatgacggtaatctcatttctgatagcaacgaacggatacgaaatgcaaaagtctgtcgagctttaaccaaagaatataaactttactttgcccctaaaaacagcaaagccagaaataagagccgtttacgtcctcatcaattacggaagtataatctacgttctgcagctcttgatgcactggctgtatctcgctcatggaatgattttcttggcattctcaaaggtcagggcatagatatgcgttttaatcatgctgagaactctgataaaattcgtggtatatccttttgtatggatgaatttagcattgcaggttctaaacttgactgtgatttgagttttaacagcctttgcgttacgttgggcaatgtaactacagaattgattattcaaccccatcaggtcataacttccagtggaggtggaggaacaagcaatgaacaaggatggcgagacgataaaaacaaggatagccaaagaaacgaacctttctataaaccctcaaaacgtagaagataatgaaagaagatgtagtagctgcgaatcttgcaaatttgcgtcaaagtatcagtgagctaaaagaatgtattgaaaaacagaatgccactgtttctaaatcggaacaatctgtaaaagtggactttgacgaaaagaccatttataatggagtcgctaaaggtttctgcacttgttggaatgaagccttgtctgtggtaaagaaacatatttggaaacaacagccgaacactttaccattttcactatggttcccgaaactcattgaattattcaagcagaagtccaaacttcttgaatatctttatcggcacgtttgcgattacaatctcaatcgtatgactattgaagcaaatatggattgcatattaaaacggcaggatgagatacttgcaaaaatcaatgaattgaaaaatccagtaaccattattccacccaatattaatgggatgtttatacgtgggcatcatataaaactccagtatgttgtggtctttattgtcgctattgttacatgggctattactgcttctgttagcagtatgaagtataaggaagaaagctttgcgtattattcgatgtatcgggctgtaaaggaacaatctgaacttatattaaaaaaatggagaaactcaaaataaagaaatagaatttgttgcatataaaaaatactgcttattaaggatttattcttttatattcttatagaatatggctaaaaggatttttcttgttattatgggatattctataaagtataaataataaaaaataaaattatgatttacggatacattagagtaagcagcgataagcagacagtagagaatcagcgttttgaaattaataatttctgtgaacgttataaacttgtaattgatggttggattgaggaaaccattagtggtatgaaatcatacaataaacgtgaattgggtaggcttttactacagattcagaaagatgatctcattatctgtgcagaattatcacgattgggaagaaatctattcatgattatggagatattaaatatttgtatgaccaaagaatgtcgtgtgtggactataaaagacaactatcgtcttggtgatgatatccaaagtaaggttcttgcctttgcttttggactatctgctgagattgaacgtaatcttattagccagcgcacgaaggaggctttggcaagaaaaaaagctgaaggtgtgacattgggacgaccaaagggaagaaaaagttctgtagaaaaatataaacttcatggaaaagaaaatcttattcatgaacttttaaaggcaaaagtttctaagcgtaaaatttctaaattatgtaaagttgatagaaatacgcttgaccgttttataaaacagtttttgacggaatgaaacagagcgttttcgtgcagcaacaaggcgtggagtgcgactttacaggctctaccccgtgggtgatattgtctcccattgaacagagtatcaaacagaagattgaagcggttggaactccacttaaagattgggatataaatatctatcgaggtgtgcttactggttataatgatgcttttatcattgatacggaaaaacgtgaagcgatattggcgaattgccagacggaagaagaacgcaaaagaacggctgaacttatacgaccgattttgcgtggcagagatattaggaggtatgaatatgagtgggctgacaagtacctcatagccacatttccatcacgtcactacgacatagagctgtaccctgccgtaaagcgacatcttctttcatttggcaaagaaagactggagcagacaggcaagacctattctatcaacggcgaaaaaatcaaggctcgcaagaagactcacaataagtggtttgaaacacaagacagcatcagctattgggaggattttatgcggccaaaaataatatggaagcgtatagggtcaatacttcgcttctcgtatgacactacgggtaattttggtcttgatagtacctgctttgccacagggcaacacatggcttatttgtgctgcatattaaattctcttatggggcattatatgttcaaagattctcccaagactggtactggagacttgcttgtaagcgtacaagccattgaacctattttgataccgatgaataaagatatggaatgcttgtttgaaaatttactggaagaggtcttggaacatcgctcggaagaaacagaaaaggaaataaaccgtttagctttcaaactatacgatttatctcctgctgaaatcaactacatcactgattttgttactcaatctcaacaaagccaataacttgtcgttctttctctgatagattatataagtcgaaaatcatggaatctattgccatggctttcgacttgctatatacattctgaatatcattaacagcagacctgaatcgtgcattcatttcgtctgtcacctgcattaccggaattttgtcaaaaaaaattttgctcatttcacgagttccaccttgtagttctggaaatgaatcacggaagcagaacttgaacaaagaagaattgaagaatgctgtaagatatgctatagcttgacctgttataatgaaacacttttgatttgtacaataagcattgtcatcatatacgaacggcatatattttgtcatgttgggatagacaatttttggcttattaaaatcctccatataagcacagttacgaaggttatatggcgtatctcctttgtctgttcttttcgatattttatcccaatataaatctaaatgagcttttatggcaggataatcttcgattttgatgcgaggtaatttaccttttataccattatgaatgttgataatccataattcagcccatttatacccgtatctcctaatatctctgccacgcaaaatcggtcgtataagttcagccgttcttttgcgttcttcttccgtctggcaattcgccaatatcgcttcacgtttttccgtatcaatgataaaagcatcattataacctgtctttattccatagttgatttgaatatcccaatccttcaaaggtgttcctacggcttctatcttccgcttgatgctttgctcgataggagataggataacccatgaatcggaagaagaaaaatcacacaccgctccgctatgctgcacgaaaacgctcaaattcttaacgccatctttattttgtttattggtgacagcgcataaagttttatgctcgttatcttctttagaaaagagtaagatgtttgtatcaactgtagcactctcaaatattttcacgcctgcgaagtctataagcaattggggatttgtattcttagcaaagaatccacgtgttttttctccgtatccggcacgcatccatttgttggacgtgatataacaaagatgacctttgggtttcagtaattgccatccacgttcgtagaaaaggcaatatatgtctcccgtttttgcgaatgttttatagtcacatggttcatagagtttagccaattcaccaccattattttgtaactggatgtatggagggttacctattactatatcgaagccatcgctgactccaaacatccaagcaggatcgaagaactctgctactgtattttggtcataaggattccatgctgccaattgtatagcatcttcaggggcaaagtctttgtcatccgccagtaatctagctaatttttcacgtaataccttgtccttttctcgtaaggtacttttgcggttagcagtttttgcagaaaaatgttcatgacggacttctatcaatttctgttttgttggctcaatatccggattctcaaataaacagtgtgaagcttgcttctttttagcaatcaaagaattggcagcgacaaactttgtttcgaggtttggtaatgtcggtatgccaaagtttggtttagaagcatctttttcacaatcgcaaatcagtgagataaaaaagcgtagttttgttatttgggctgcgatactctgaatgtcgctgccatagatgcaattttctatgattgccaatttcaagtcatacactttctcatttggagaaatacgacagagcacatctatcatgcgattaagcaatcccatcgggaatgctccagaaccacaagccgggtcaagtattttgatagcctttaatcttttagcgacacgctgatattcttctggtttttctctgtcaagggtgaaatctggattgaataaggaacgtacaaattgagtatctcctaaataggcaatgagactttcgtctaccatgtaattgactatttcacggggcgtatagaacgaaccactttgatttcgcgctgtttcctttgtttcggggttgtatgcgcctaatagattctcaaatactttacccaacaattctgggtcaagggctacctgctgttcttcgggtgaattttcctctattgtaaagttgtagcggctgaggattgaaatcagtcctttctctgaatcgaagaacagattgttagggataatggcacgattgcgatagcgcccatcagcaaaacgtttgtcgttgcgactgaagccatcataattgtaggcctgttcaacaccgtcaatcgtcttggtcttatcaaggcattcaaagagtccaccattaaggaaggggacttctgagaataaggtaacgacatcattctcgctgatgttaaacatttcggcatagcgatagagggttttgatatctttctttatattggtagcgaacttgcgtttgtttccttgttcatcttcaatagcacggttaagtgttgcaaagaacaagttctggagaattgcattgtaatagtttccaacagtctgactatatgggtcaaactcttttaggatagtctgcaaataatcaatatcgaatatccgttgtggtaccaagtccttctgcttgatgaaccatacgaacataatacgggtaataagtcgaattacttttgtttctaaatcctcacggtcatcatcttcagttcccgtattattgggaaaagaaacattagatgatggttctatagcccattgataccattcgaataaatccttgtagaactgctttgtgagtgtctcgacagaaaatgcattcgttatgtcactgagtgtctgtttgctatttttcaatgtgccaaactgttctatggcagtacggcatccacgaccttcgccaagcaaatatgtatagcgttttgtattagttgacatcttttcatattcgccttgtttgttaaacccccaagtttcacttacgtatgagaatctaagaatgctttcatccttacgataacagaacataaatgctccagcataccccatattacgccaatctgtagtgagcatatcacgaatgccacgacggttacgctcaatgtcaactttgtcactcaattccacttcgtatatggctatagattctccatctacaagagatattttgccaagattcaatgcttctttagctaagcggctacttacgtggaccgcagaaggagtgttccaaaaactaattttgtttcggaatatatcataaagcaatttttgccaagcctcacgattatatttagattcgatgacttctttgtagttcatattgctatttttagagtttattgaatgattctgataaaataatttctgcattagtctcttgctcattaagcagagattcttgtgccgtataatatggtgcatacttttttgccatatcaatgatttctgcaagtgcttcatcatgtgtcattctggctttacctcctacgcgacgcaagtttttctgtatgcgttgtaagcgtttagctatgtaggtgatgacacctctttccgctaatgttttgagctgaactacttttatgtatagttcattatcgtctatttcacgaatgaaattatttaacaaatttacagcggtactaacttgcactccaacagaaccttgttcctcatgggtagtttcttgagaacgtgcttcttcatcctgcatcatgcgaaattttcgtaaagccatattaatatgcttatggtgttgctctatacgctctgcggattgttcttctttgggagctttgaaatattttagagcatcaagcacagaaagttcttctgctgtttctgagaccaaaaagaataccttacggaaattcgttttcaggaatacaagagtgtcatttgcaagtgttactccatctacttttttcatttcacgaccagtacggctacgcaatgagagttttgctatgcgattatattctctacggttgttttgatagagtgcacggagttcctcgtaatatggcaattcttgattacattcttccttttgtttcttcatgccttcatcaaagagtttacttaagtcgcggtcaagaatttcttcttgtgagtaaatttggttgtcttcaccgaaggtggaatgaaaggtttgaatcttacttaatgcgatttgatttagattgatttcacggtttccttcacgggatggatagaaaacgtaattgtatatatgtttggatgaagaaccgatacgattgacgcgaccaatacgttgcatcagtcgggtgctattccaaggagtgtcataatttacaatcacatttgctcgatgcaagtttacaccttcagcaagcacatctgtggtgaggatgatattgtagtcattgagttttgtcttatagttagcatcaaaattctcacggatagttttgaactgcttactacgattatcagcggagattaccaatacgtctttacgattaatacggcgtgccaaatactctactgtgtcaactgattctgaaaatacaaccagtttctgttcgggattgcgttccgatttgaacaacttatgcttaagcagctcattgaactttgtgaacttggaatcatcttcgtcttttatatctgcccattctgaacataacatttcaagtgtattctgatctcctctaagcatttctataaattcaggcttaaaatcatcagcagtgaatactgcatttttgggattatcttccgctttggcatttagtttctcctcaatttcttcatcactcaaccctgattctaatagcatattgatatcaagatccggagcaatgaatactttgttgcggtcaaacatatctatcatattttggtttgcttgacggaaattgtctaatgaaacttggaaagcataaaaactgctttctagccgcttcaccaatccgtttttacggattccagctaagctgcggcttattaattccgcgttatcatacagtccttgtgccgcttcaggcttcaagtaggctatagcttgataacgagcgtacgtcaagttcttttcaagagtaagcatagcatgttcaaacaaatcagcgagatgctcattaagctcatatcgactttctataggacgctctacttttggaaagccattcacatccttattatatcgaggcacgttctcgatgtcagtacgtgtacgccgaaccgtcaatggcttgataacgcggtctcgaactcgttctgctaatttcttgaatcgacttatgtcgaaatttggctctctttttagctgtttaaattctttaataagaggtgaaaagaatgccgttaaatttgatacaccatcaatcgtacatcggcgtggatcttggaataattggatttctgtgtatatatctgcaggtgtattattcataggtgttgctgaaataagcattacctttttcttaaagccgggaatatttccattttctatacggggcattttgcatatttcctgcaattgctcaaaggcagaggttgtatgcgagcggaatttatgtgcttcatcaaccaaaataaggtcaaattcatcagcattccagtagttataattgtcttcatcgagaatcttagacaaactgccattggaaataaaattaacatacttgtcaatgccaaaatctttaaatgttgctttccagttgtgttctacggcaggtggatagacgacgagaatttttgttttgtcacgcccattctcgattaagaatttcttagctatcattgtagcaattacagtcttgccaagacctacaacatcagcaagaaaaaagccatcgtaacgcagtagcttttgataaccttcttccacagcatccatttggtaatcatatttcttatacccttccggcatatcaaatggattgttatcgtctgttgccatgactctatccgaaaaatactccatgagcattttaatataaaggtcataaggtgaagcatcacctttgaggtatgtatgatctattgatgtttttacatcatcagccgtaatttcgcatccttcggcttctttccataataattcaaattcttctttggcaaattttacatcatcatatctatccatttttacattaaactcatactgacgttcctccgtgatgcctagtccgtttccagtaagattactggaaccagttatagccattccttgggtgtattgattaaaatcgtttggataaagtacgtatattttggcatgtattttttttgaaggatgcgctcttagttccaatttaccatcaataaggtctttcaccatttggaacattccattttcgacctctttgctataatgcgaatgctctatatctcggcgaatttcacgtagacactcttcttttacttcttcttctgctccaaaaaatatctttccttgccttgttgcttgtgcaatgtatttatctacatttattcctattaagaccctaaccttatttatgttgtctaggaaaggacgtaaagaaaaatatcctgatgctctgagaaaaccgacaactgcatcaagattacaaatatgaggattatggtgtagtatgccctcaaattcttttatgagggtattgttgtctctattcgtgaaaaagttagaatgagtatattttttaacattatccatgttcttgataatttagatatttatttctgagtgttttctttttcccttctttcttttaccttttccaatcccggcatctttttagccaatgcactttctcctgctggaaaatagagaggaaaaactttatataagaaacccacaacttcactacgacttttatccatattgtaaaaagcagagcagacaaagtacattagttcttgctgactacatgtttctttgggctgtatgcttattgagggagcaactatcaagtcatgttcagcaaatgatagagcactggcaagaatagcttcctgttctttttcggtaaacatctttattttcccagctaaccattcaagctctctttgctgaagtgcttgttgtttttcgttttgatgctccaataggattgctacattttcttgttgcttttctgtcaaggcgttttctaatgcttggttctttcgtttaagaacattgaacttcagtaaagcggcaatatacatacagaaatatcctactgcaatatcgaatattaggacaagcagataattgttacttgagttttgtatgccaccagccatatattcactaatagggataacagctaataacatgatgatggctattgcataaagtactttgtatcgcgttttatggtttacctgtggcaaagaggcaaacaaaaaggcgataatcaaaacggcaattattacactgaatggtatgaaagatgtctccatagttttattgctcagtttgagggttaacaataatgcgccaatagccaccatgatctgctccttcacgagacaaaattcccatagaacgaagctttgaaatatgtttttctacggctcgggagcttattcctattttataggccattgcttctgcagacattgatgggtcggaaatgacgaaatcaataatcttttgtgtggttttcccaatgcttttagatttgtttttcgaatctccgaactttttctccgaaccttttgggattatctccgaacctttctccgaactttcttgcgtattaccaaaggttttcaccgaacttttgctgtttccaccgaacttttccaccgaactttcttcgttttcagggtacttttcgagggtactgtttaccctgttagccacttcctcaacaggtattcttccattgtcaccccagttcagattatagaatgtggtgtagaaagaagtcgcttccgtttgatattgtggttctttgccttgtaggaaattgggtagcttctctgtaagctctcgcattttgcgtaagccggaaccacgtttctccatatagtccaattgtgtgaacatatctgcaatgacagggttgcggcgcatggacggcactttgtatatgtcacggtcttgaatctgtgtgccgtcaagcatggcaccaggtgatactagttctactcggtcatcgtaaatgtcaatatgtacttcaccgcccatcatggtgtaatctcgatggataaggtggtttaccaatccttcgaagatggcgcggtcggaatagtcggggaggttaaggcgatagtttggcatcttcacccagccactcatggtatagtttttgatgaaatccataccatattttaagagcagcacaaggttagcccgatgttccacggaactgatggcatcatccttatatagtccagtccaacgggtgcagaaaatacgcgattgaaataccgtgcaattatccacaaacagcaatcctgcattggtcagtttgtcgtcaggagttactagtccgaatgattccagatacttgtcgttccattcttgatgggtttgctcacggaaggtattggcaaggatgatgaaagaatgtttgctggcatccacttgggtaggaagagaatcccatgtcatgtgcgtacctttcaataccaatgaaagaagttgttgcgaattacactccacactttcattgccaattcgtatatatgcggtacgtgttccatcctgatagtaataataaggtgtaagcgttcctgtctttactttcacttcaagcagggtatgctcttcgtgttctatcggaataagttgaacttccggaacagggtcaagtcttgcctttatcatttcactgataaaatcagcatcggcttgtggattctccaaccctacaattacgccgtcatcattcactccatagaacaaactgccaccatccgtattagcgaaagccgacacggatttaagccacgacttcactttcttacgctccaacatttccttgaaatcgtaagccgagcattctgttatcaatgtattgttatgtatctgcatagtttctttattgttgttcgggtataatatcccaatatcatacacaaaggtaaggataaaaccggatattttgttaaaatcagcccattgatttgactattatgtgtttgtattctatttaaaatgataaaatacctatttttgtaattaagaaattctctttgcatgaaactataatgttacatgtgttagattctaatatgtgaatgatagataatgtcttatatctgatttaatttttaattgaaatatttgagatcagagtgactaacaaaattgtaaagttatactaaaagataaattgcctatgacaacatataataatccatcagttggtgatattattcgcgtaaaaattaccagtataaaaccagatctcggagcatttgtaaaaatgcccaatggagttgacggtttgataagacttcatgatatatcttggtctaatcagtctgtgactctttcttcattatcggaaggtgatgttcttgatgtaaaagttatcaaagaattaccagatggaaagttgaatctaagccgaaaaaatcttctacccaatccaagaacagttgaaaaaggtaccatatacaaggttattataaaatctgttgagagtttcggtcttattgtaaacttaggagacagcacggcacttgttcatgtaagtgaactcccaacaatagaatacaaagaaggtgaagaaattacttgtgttgtaattgacaacaattacgacccagagaagcatcgaaacaaaatttcgatgagtgtgttggctttacatgattattttgcaaaagtacatagtgagaatgaacgggtaaaatgtttatttaagggtatcattaaaaatgaaaattccacatctgctcttattgaagcagatggattgataaaggtaattgtacctttaaaacgttttgttgaaccttataaaaccagactattgaacaatgaaatagagactgatgaagaacttgaatttgttttcattaaatataatgaaaagttaaaagatgttgtcttggatatgcgtccaatcgaggccgaggaaaagaaagctagagttgattggttacgttctcaactaaataagggcgatatcattgatgctattgttaagaatataaacaataaatttgctactatagacattggtaataccggaatcttaggcagtatatatagggatgaactgtcaccaaataaagttattcgtgctagtgatgaagtttttccaggagaacatgtccgtgttgcatatatgggagaagacaacggccagctgatttttagtagaaagttttttgttgaagataaatacgaagagagcctttacgaacttagtcttacagatttactggctactatgggattaacaaccaatcgttttattggcaaagttatagagattaattccacgtattttttcacaaatttaatgtctacaggagatgttaaagaagaaaacaatggcaaattactagtagatccaattaatgggaagtgtctcattgccatcgttgataaccgattgcgtaatttttttgtttctggtaattattatgagatagagattgacatgccacgtaaagaataccgcatggaacaaggttctccttatatgttttgtgtatcatcaaataaaattaaagaagcagaaaatccatataaagagtctgtttccctttcttttaagcaacatacaagtccaaacactaatacaagtgtagctaacttgcttgaagaagtaggtcagaacctctatactagtaaaaagagaatgttttttgaacttcttcaaaatgccgatgatgctgccccagagaatggcgttaaagtaaagttacaacttagcgataattattttgttgtaacacacgatggatttgcatttaataaacatgactttgaatcaattacatctgctgcaaaaagcacaaagagtgcaagcagtaagaaaacaggctataaaggtattgggttcaagtcagtattcacaaattctgagtctgtattaattaaaagtgctggctacaatttttctttcgataaaaatttaccaatctataatgatttcaaagccttttactaccatgttaacgatattgagaatgatgtggaaaaacagaaagaatttcttcacaaatatctaaaattctttagggaattcaaaggtgtaaaggatattccttggcagttattaccgatatggtatgaatcattaaaaattgatccatatgattccattttcaatcaaaaagaaaatgttgctattgcattaaaaatggatgaagaaacactttctgaatatcatgaggcgattaaagaagtgttttctgaaccacgatttatgttatttctcagaaacactaatcgagtgcaattgatagataaggataaatgtcttactattcaaaagaaaatagatagaaagaataacatagtttcgcttgtaaactctttcaatgaagatcgtttatctgaagatttttgtatttattcgtcagataatcttttagtgaatgacgatgaattcaaaaaggcaggcattcaaatcagaagaaaagaaagaactaataataggggtgaaaaagaaaactactttattaaacttgatcaagatggtaatgaattaacagaagttgcaggtattccagaccgtattgcatcggctaaagaaacaactatctcatttgctatcaagcttgacgaagatggacttgttacgccaatcaatgaagatgatctctcattatatgcttatcttcctatgaatgagcacagattcaaattcccattttatttgaatgctgattttattcccaagtctgatagagaaggaattcaaagcgacaatccatggaatttcttcttgttctatatgattggaaagcaaattgtaagtatggtttcaagctatgcttctgaactcaatgtaaattatcttaatttacttccaacaaaagaactcacctattttagtcaggatacagcaacactagtcgattcgtttaatcgtggatataaggatgctttaacaaataaagcatttatacttaatgataataatgatatcgtagggccagataatattatatttgatgcttctggactatcttctgcaattggtgcatctgatttctataagctaataggtacaaccaaacatttacctcatgaatctattgattcaagttcattgtcaaaagaaatatttggaatagaaaagattactacagaaactgttatcacaattctattaaataatattgatacccttaaaaaatggattattgattcttgtgatgataagttacgtacatctttctatgaatggttggcaaaagaagaaaaagcgcattctctaattccacttgttcccacgtttatgtttgggaaagaatggaaaacaacaaatgaagttaagttagaagataaactcttgttttcaacagagatgatttcaaccataaagtcagtattatcaaaacttggttttaaatgttctaatcattctgttgaagaacacccattatcattgtttattgttagccaagatgaaaaagcaatttttgaaaaaatagaggaagaatccttagattctctcacatttaatgagagattgcatttatttgtgaatattgcaaaatttaaaaatattggggttgaaacattaaaaaaatggaaaatctttaaaaatcagaatggtaaatatagtccattatcttcaatgtttgcgtataattccaattgtccggtttggctatatgattatatgttaaagcaagaagaaaataacagcttaattactaggcaccttgttgcatcaacagatatttattcaagcattattgaaccatatattgatgacttgataagtattacagatatttcagatattcataaaacattcttgtcatattggagacccggatttacgataacattgttttcaaaaagcaatatacctacaataagtttacttcgcattgtagagcaatctgatactaatactcaggtagcatatgcaaagagcataaaagctatgccacttttaagtacgttggaatatgacaaaaaatctttcgaatatagatggatgaagatggcattatccaacaatacggctgtttctcatgcacgctcaataataacaattaatggtaagagtttgtcagaatataatcttaaagatgatttttcaataaacataggtgtaaaactctatacattctcgctttcgaaaatactaccagcatattcatcatcttttatacttagcaatgtaagttcaaagttttcaagtatagatggattcgaaaagatatttgctcgaagggaagttaaccttactgatgttcgaaatcagttatataaagaactaactgcatcaactcaactaatcactgcagaacaattctgttttcttattgtgtatagaaagttttgtggttacaattatttcgataatatgctaaaatcatgtattcgtgctaatgatcagaatcttttcattaaaatacttgacaagagtatggcactagatattgcagatatattaagtcctgttattacaaatggaggagttcaatatccttttgataaattagttggaacatatttcgatagtaatgaattcactttaccaatagaacaagtgccttcgtttattgagaactgggctaatacgtttgaaaaaaaacaattcttgattcaacttgggttgcatgacaaagaaagtaaagagatactgcgaagaaaatcatttaaagagaataaattagagaatatatggaatcttaatgatgctaacataataagatctttctttaattgggtagctaactcattccaacttcctatagaatcagaaagccaagtaaatatattgtcaaatctatacaaaactttacgtctaactggttcatattatgaagatgatttctgtaaagcagcagaatggtcaaatcaattgtatttagattggaaacagaattcaagaatgtcaatatacataattgagggagaacttccgtatagaggcatttataataatacttacttatttaaaggttatgcgggtgaatatacatattttgcaaacactagacatatctatatatcagcgaatagagaaccagcatcttctctagcggatatatactccaatactacattattaaaatgtcctttttctaaagaggattggaatatgatatttctcgtatcagcggatattgttcaagaaaaggataaacgcatagcagaacttgagcgaatgcttgaagaaacaaaaagtaaaaaaagaatagacggtgattattatgaggatgaagaaagttacggcaatgtttccgaccgggataatcttgacaaagaatctcgtatagagatgaatttggaagcacgtaatgctgcaaaagattaccttgattcattagaggattatgattgctcaggatgggatcctaatttggggaatggtttggttaaaggtattattaaatttaaagggaaattaataaccgtagtcgtaaccagttctataggacgaaagctataccttcatcctagattattctcagaattaatgatagatccagataatttgctactcaattatggctatgatagaaagatacatcgtataagttttaatgatacttttaaagacaataaggatgtcaaccttatatttgacacggatatcataactcctaaagaatttgcatatctagctaatagatatatgtactcaaaaaagacatgcttcgttatagaaaatataacatattctatttcagaccaaataaatggttttggacttgacgaaaagatgtcagtttctgatgtttatacaaatattgatacagatgaattgtttgacttttagaataaaaatataatgtattatacaagagagcaacataagagatttcttgataaagaacttgtagcaataagtgaagaatatctaaagaaactcaattctaaagcaattgcattattaacagataatgaagtgtatgttacacagtttgtaaagcttgatttacaaatggctgattccaataatgcagaccgtaacgtattgggatctgggcaacttatacttcgttttaagaaggataaaggaattccacgcaagaatgaatattttactgcagtcgtattagaaaaagaaatgagtattccaaggtattggggagaaatcagttggggtaacttgcgtcgtcaccaagtcgaattttcggaagtacattgtgtctggcagggtaaaacggatgacaatggtttcctactgtgtggttttactggattgtcaatagatatggctaaattcctagaaaacaaagaaggatgtgtaattgtccttggccctcaagagccaccaatggattattatcagaaccttattgatatcgttaacaacaacgacacaaatatggtagccaaggacattttggattttgataagaagtttattgtatggaatcctattcatattaattcaaataaagaacaagttgaagagatagtcaagacgttagaatccacttctcaactgatatttcagggccctccaggtactgggaaaacttatcttatggctgaacttgttgcacatttgctgagccaaaatagtagtgtgcttgttactgccatgactaacagagcactgatagaacttgcagaaaaggacagcctaaaaaaatacctctccgataagcgggtaatgaaaactaatgtatcttctgatgaacttattacttgcaaaaatctttgtcctattgatagtaaaaaaataacatgtatttctggcaatcttacattctcaacattctataatacaagcggttgggctaaacaaagttattatgaacaaccgtttgactatgtaattatggatgaagcaagtcaggctttgtttggaatgatagctgcatgtaaaaatcttggaagaaaggttatatggattggtgatcaaaaccagatgcagccaattgtattgttaagcgaagaaacgcttatgaggaatgacttcgctatgcttgcaaatggtttttcaacactctgtgagaactttaactacaagtcgtttattttaacagaaacacatcgtttattgaaaaaatctgcggatttgacaagtattttctatcatacacctattaaatcggtagctgactttaagtatgagttagcaaatactactatacactatattcctaaggaaggtggtacaattcttattcctaaggagatgcctatcggtgagaaagcagataaaggcagctgtgatttcactattagaattgttaatgatttattatcatcttatcctaaattgaatattgcagtattaacaaaatttcgtgctgcagttagaatgttacagaatagttttataagtaaatatggtagcaaaaacaatgttctcatcgacacagttgaacgagttcaaggtatgacttgcgatgtttgtatttattatattcctaacacaatgattggaatgtctcttgatagagcactgtttaatgttgcaacaagtcgtgcaaaacaactaacaataattgttgcggataaatcaatactcaatacatcatgccatagagatgttcgttcgtacttaatcaaaataacttctggtattataccagaaataatagatgagtattcaaataaacttaaagatagtataattgaaggtaacgggataagtttgcatctaaaagggaaaatagacctctcaaaatttgagacttcaaaacaaaaatctgttaagtcaaccaccccaaagaatatatatatcatcgatactaatgtgtttgttaattgtccagatattatttctaagattgatgaacattatcaagttgtcatgtctgcaaaagttatagacgagttggacaaacttaaaattaagcttgatgcggcaaacaaaaaaaatgtagaaacggctttgcgattgatcaataaagcaatggataagccgaatgtctcaatggaactttctgatcctgatttattgccaaatgattttaataaaaaatctccagataataacatattaacggtggcacttaaatttaaaaatgaaaatcctattcttttaacttccgataatggcttacaagtaaaagcaaaaggactaagaattgcaactattacacttaaagatttcttaaattagtatgtattcgaattgcatattttgttaaaattaccctattgatttgattattatgtgtttatatcacgatatttatcaaataaatctgtacttttgcagtaaagagctgtggttgcttatggatgcttattttcgggtttgcactatatttgcaacacgttcacgcaagttgctcatacagagatgctgttgactttggaggaagtgaagtaagtaagttctaaacaataggtctacatatagaaggccgctgcaagacgagtgcttgtggcggcctttatttgtttgaactaattttaactattccggtgaaaccaagcaatctccggattgttgtactctgcaacggtataacggacggagatatgtttggaaaatcaggtgatttagaggatatgaggaaatggcgggtatggaagctgaaattgatagatgcccgtctttattttgtcagtatattcgtgggattgttgacagggcttgttgctgtaccctatcactatctgttacaattcttttttaatactcgtagaaacttttttgattcacagccacattggtattggcatattcctatctttttgtctttatggggtatcctcttatttgtgatgtggctggtgaaaaagatgccgttgatcaccggtggggggattcctcaaacccgtggagtgattaacggacgtatctcctacaagcatccttttatagagttagtatctaagtttgtgggaggagtgttggcgttgagtgccggtttgtctttgggacgtgaggggccctccgtgcagatcggatcttatatcggttgtctggtgtctaaatggggaagggtgcttgccggtgaacgaaaacaactgcttgccgccggtgcaggtgccggattggctgctgcttttgccgctcccctggcttcttcgttactggtcattgagtctatcgaacgttttgatgcacctaagaccgccataaccactttgctcgccggagtggtggcaggtggtgtggcgagtatgatctttcccattaacccttatttccagattgacgctatttctcccggactggttttttcttcacaagtcaaattgttcttattgctggctgcggtaatttccgtatccggtaagatttattcggttattacagtttggtttaagcgactttatccggccatcaagcatccggcttatgtgaagatgctctatttgttgtttattgcttatttaatatcactcacggaagtgaatctgaccggtggaggtgaacaatttttattggagcaggcgatgcatgctgacacccatataatgtggattgtagggatgatgattctgcactttgtttttagtgtgctttcgttttcttccggattgccgggaggaagttttattcccactctggttaccgggggactgatcgggcagatcgttgctttgattctggtacgtcagggcattatcggatacgaaaatatcagctatgtcatgctgatatgtatgtctgcttttttggttgcggtgatccggactcctttgacagcaatcgttttgattaccgagatcaccggacatctggaggttttctatccctccattgttgtgggagggctgacctactattttacggagatgttgcagatccagccgtttaatgtgacactttatgatgacatgatcagttctcctgactttcaggaggagaagcgctatactctttctgtcgaagtgatgagtggttcgtattttgatggaaagacggtaagcgaattactattgccggaacgttgtgagattatcaatatacaccgtgatcggaaagatatacccccggcaaagcaaaaacttgttccgggggaccaggtgcagatcgagatggatgcacaagatattgaaaaattatacgaacctttggtaagtatggccaatatctattgagcttgttctctcagccaggctatttcttcgggccacagtgtttcgtcaatggtctccagaatcaacggcatattgtcgaaacggggatctttcattagtttctcaaagaaagcgaaaccaattaatcccttaccgatgctgtcgtgacgatctactcgactacctaattcttttttggaatcattgaggtgcatcccccgcagatattcaaatccgactacttcaccgaattctccgaagacattatcataatcattcagaaagtcataaccggctgtaaaagtgtggcaggtgtccagacaaacccctacacggcttttatcctccacgcggtcgatgatgtacttcagctgccagaattcatttcccaggttgcttccttgtccggcagtattttcaataacggcagttactccttgggtcttttccaaagtcagattgatgctttctgcgatccgatccagacattcttccaccggtatcttgttgaggtggctgccgggatggaagttcagcagtttcagtcccaattgttcgcaacgttgcatttcgtcaaggaaggcagcccggcttttggacagtccctcttcttcgggatgtcccaggtttatcaggtaactatcgtgcgggagaatgtattcgggggcgaatccgaatttctcacaattttctttgaagagacggatactatcttcggttagtggcttactgacccactggcgttgatttttagtaaagagggcaaatgcattggccccgatttcgtgtgcattgacaggagcgaactcaacgcctcctgatgcactgacatgtgctccgatatatttcatattcttttctttgattcatatgcaaagataacatttccgtaacaatatatgttttgccccgtaacaatatatgtaatgagtgattacatatattgttacggggcaaaagctctgatggtatccgacggttaagccagattgcctatttcatccagattcttttggatatcatcatctgtaagcgaatagtttaccaagtcaccggacaggtatttgtcatacgaagccatatcgatcagtccgtgaccggacaggttgaacagaatcactttctcttctccgctttctttgcatttgtttgcctcacggatggcggctgcgatggcgtggcaagattccggagcaggaataataccttcaacctgtgcgaacaggcatccggcttcgaaagattccagttggctgatatcgacagcttccatcagtttgtctttgaggagttgcgaaacgatcactcctgcaccgtggtagcgaagtccgccggcgtggatgttggccggagcaaagttgtgccccaatgtaaacataggcaacagtggggtatatcctgcttcgtcgccgaagtcgtattgaaacttaccgcgagtcagcttcgggcaagatgccggttcggcagcaatgaagcgtgtttttttaccttcaaggatgttatggcgcatgaatgggaacgcgatgccaccgaagttggaaccaccaccaaagcatgcgatcaccatatcgggatattcacctgccattgccatttgtttttcagcttccaggccgatcacggtctggtgcagggtgacatggctcagaacggaacctaatgtatatttacagtttggagtagtttgagccagttcgatggcttcagagatggcggtacccaatgagccttgatgattcgggtgtgcagtcagaatatcttttcctgcacgggtcgacatcgaaggcgaaggagtcacctgggcaccataggtctgcatgatgctacggcggtaaggtttctgctcataactgattttcacttgataaacggctgcttccaaaccgaaaagtttggcggcgtaagccagggaagctccccattgtccggcaccggtttcagttgttacattctgtacaccttcttttttacaataataagcttgtggaatggccgagttcaatttgtgcgaacccatcgggctgacactttcattcttgaaataaatatgtgccggtgtgcctaatgctttttccagcccataggcacggaccaatggagtactgcggtaatatttgtacatttcacgaacctcttccggtatttctatccattggtcggtttggttcagttcctggcggcaaagctcttccgcgaagatcggatacagatcttctgcctttaatggctgtttggttcccggatgcaacgggggcatcggcttgttcaccatgtcggcttgtatgttgtaccagtaatgcggaatttcttcttcaggcagtatgtacctttttttcttgtcgctcataatattgtagttatttgattattctgatgccaaaagtaagtataatttttaagaattatatgatttcagcaacaaagaatcggatatgtttgttattttagttaagtttgtgcgactctattaatatgcaatccgatgaagatttatcataaattctttttgtaccagaataaattgttgcagccttacgtacgacttttgttacgattaatggcaattatcacctatctggcttccatcatgctgatagtcggagtgatttacgaacatggctttatgctctctgcccatgaagttacgaaaatacatcttctttataagacggtttggattatattcctgatcgacgttacgctgcatatcctgcttgaatatagagatacgaaaaagaatttccggaagttggcctggatactgagctggttactgtatctgactttgattcctgttatcttccatcggcccgaggagggaggggctattctgcatctgtgggaattcctgcacggttacttttaccatattgtcttactgttgcttttctccttactgaatttgtctaatgggctggtacgattgttgggcaggagaaccaatccttctttgattctggctgtcagcttcctggtgattatatttatcggatcggggttgttgatgttgcctcgttgtactgtggagggggttaccttatcgtgggtcgacgcgttgtttacttctaccagtgccgtctgcgtaaccgggttggttcccgttgacgtatccgctacttttacgccggccggactgacagttatcattcttttgattcagatcggtggtctgggagtgatgacactgaccagtttctttgccatgttcttcatgggaaatacttctttgtacaatcagttggtcgtacgtgatatggtaagttccaattcattggggtcgttattctctactttattgtacatattaggttttacattggtcattgaggggataggcatgctctctatctggttcagtatacatggtacgctggggatggatgttcaggatgaactggctttttctgcctttcattccatctctgccttttgtaatgccggattttctacgttgcccggtaatttaggcaatccgatgattatgacccagcataactggctgtatataaccgtgtctttcctgattatttttggtggaatcggatttccgattctggttaattttaaagatattatagtttaccatgcccgtcgtttctggcgtctgatccgtacccgccagtgggacaatcatcaggtacatcatctgttcaatctcaatactaagattgtattgataatgactgttctgctactggttttcggaacgcttgccattgcttttttcgagtggaatcattcgtttgcaggcatgtcggttgccgataagtggacacaggctttcttcaatgccacttgcccccgaaccgccggattcagcagtgtagacctgacttcactgagcatacaaactatcatgctttatatagtcctgatgtggatcggtggtgcggcacagtccacagccggtggtgtgaaagtaaatgcttttgctgttgcctcactcaacctgatcgctgtgctgagaggaaccgaaagagtggaggtatttggccgtgagttgtcacatgactccatccgacgttccaatgctgcggtagtcgtttctttgggaatcttgtttgtgtttgtctttattctgagcatactggaacccaagatgtctatcatgaccctgacgtttgaatgtgtgtcggctttaagtacggtcggctccagtctgaatgccactcctttgctgtgtgatgaaagtaagttgctggtatctctgcttatgtttatcggccgtgtaggatttatcactctggtgctgggcatcgtgaaacagaaaaagaatacaaaataccgttatccgagcgataacattatcataaactaatcagttgaatttattatgaaatacattattattggtcttggaaactacggtcatgtgctggctgaggaactttccgccttagggcacgaggtgataggggccgatttggacgaaggacgggtagatagcataaaagataagattgccaccgcctttgtaatcgatgcgacggacgagcagtctctttccgttttgcctcttaacagtgttgatatggtgattgttgccattggtgagaatttcggagcttcaatccgcgtggtggctatgttgaagcaaaagcaggtgcaacatatttatgcacgtgccatcgacggagtacacaaagcagtgcttgaagcatttggactggagaagatactgactccggaagaagatgccgcccgaagtttggtgcagttgctggattttggtacaaagatggaaactttccggatagattcggaatactatgtagtcaaattcaatgttcccgagaaatttgtaggctattttgtcaatgagttaaatctggatgaagagtttcatttaaagctgataggactgaaacgctccaataccatcaagaactgcttgggcatttcgttggtagagcacaagatagtgaacgaattgcccgagaatgccaagattcgtccggatgacgtattggtatgctacggtaaatataatgatttccagaaattgtggaaggcattgtgatagacaaataacggaagacgacgaatcattgatataaaaatgcgccataaatgttattgtctaacatttaaggcgcatataaaaagagggaaaattattctttcaatgcttcttccagattaatacccaaggcacaggctactcctgcaccataagccggatcagctttgtagcagttgcgcacatgccgttgtttgataaacagttctgcatcgcccatagcacgtgcagtattttcgaacaataattgttgttcattcgcaggcatcagtcggaataagtcacccggttggctatagtaatcgtcatcgtattcgcgttcgttatagttgaatacatctccatgaaccttcagaggcggttcctttttatccggagagtcttgccattcaccatagctgttcggttcgtagcctttggccgagccataattgccatccacccgcatagccccgtcgcgatggaatgcgtggaacgggcaacgtggcttgttcaccggaatctgttcagagtttactcccagtcgatagcgttgtgcatcgccgtaagagaataggcgtccctgtaacatcttgtcgggagagaaaccgataccttcaacaatgttcatcgggttgaaagccgattgttctacttctgcgaaatagttttccgggttacggttcagttcaaggatacctacatcctgtaacgggaaatctttgtgcgaccaaactttggtaaggtcaaacgggttgatgcgatagttgtcagcctcttcttctgtcatcagctggatctggaatttccatttcggaaaatcgcctcgttcgatactttcgtacaagtcacgttgatgtgattcacgatctttggctatgatggcttcagcttcctggtcagtcaggttcttgatgccctgcatggttctcaggtggaatttaacccagatacgtttgttctcagcatttaggaaactgtaagtatgactgccgaatccatgcatgtggcgataagaagccggaataccgcgcggactcattgtaatggttacctgatggagggcttcaggcaatagggtccagaaatcccaattgttattggcactacgcatgttggtgtgtgggtcacgttttactgcatggttcaaatcagggaatttcagaggatcgcgcagaaagaacacaggggtattgttacctaccagatcccagtttccttcttctgtataaaacttcatggcaaatccacggatatcgcgttctgcatcggcggctccgcgttctcctgctacagttgaaaaacgtacgaaacattctgtctgtttacctacctggctgaagatagcggctcgtgtgtacttggtgatatcgtgtgtgacggtaaatgtgccgtaagctccggagcctttagcgtgcatacggcgttcggggatcacttcacgatcgaaatgagcgagtttctcaatcaaccatggatcttgtagcatgattggcccgcgggggcctgctgtctggctgttttggttgtcggcaataggacgaccattagctgctgtaagttttttcttttccatatagttttggtttttaccggaaacaaagctttcaatgatgtgaagtcttttacagcccctcttccgtgttattacttgacaaaagtagcgctaaattgtttactcgtcaaatagataatttcaatccatggataggtgatatctatttctatcaaagatatcagttttacttggatttgcaatgtttcgtgggaaaaaatataagatgtaagtgattctattttttccagccgattgtttccaaaaaccattgggtattagtttcgttcagtttttgctccttgagcatttccggcatttgactatagtttcttttgaatgcttctatcagtttgttaaaacgttcgggcgagtaattcagtgcaatgctggtcgcttcggttgctcccatggcaggggtcaatacgatcccggcatcccggtatttgagcgcagtgacagccttgctgaatcgtttgaattgtgaaaccattccgtcatttaattccgggatagaagtcggatattgaatttctatcgtgtttccctggctgcacgatgtttccggtagagtgatcagtaatgccaattcatcaccgatgtattcatattctgctttgcttccattcacggtgattgcttccggaatggcggaacctaatacttttatcttaaactgacggttaggcggcatgttgcgatagctgcctttccgaggagcaatcgttacggttaaaagattatcttttcgttcacaggccatccgggtacgggcatattcgttggcataatatttatcattgccgttgtcttcatagaaacagaacgaaccgcttcctccagggaatacatttacgataatctcttcgttattgctgttcagattcttcacccggttgtaaagagggagtacggagcccgcttttacgtataccggatattcggtcagtgtaaacgagcgttctactgtctgtcctcctttcaacaaggttccggttgtccattcaaaccagtcgttaccttccggcagccacacctttactgtggaaagtccgttttgcatgggagtagtgatgggggctaccaaaatctggtcgccaaacatgtattcgtttctgaaatcgtatgcctctttggcttcaggataatcgtaatacatcgggcggcagatagaaataccattatcgtaagtctcccgggccatcgtatatatataaggagccagttggtagcggaataggatcgagttacgtaaggcttcgaaataatcccctttgaaattccataattctttattcaggaccgcattctttgtagagtgagttcgcatcacgggtgtcagagcaccgtattgcatccagcgggtgaaaagttccggatcgagtatttctttttcaccgcctttgaacatgtgcccaccgatgtcatggctccagtaaccatacaatacattggaggcgcagttagtaaagtaaggttggaattcaagcgatttccatgatatgacagcatctcccgagaagccgatctggtaacggtgattgcccagtcctccccagcgatgatagagcatcggacgcgtatcacggttacgctccatatccgagaagaaaacataattgatccaccaggtattactgaggctgtccactttcttgtcatacatccattgctgccagtcgagccaccagaagtctactccttgtttttccatggggcggagtaccttgttcagcataccgttcataaaatgtttgtccgaaactacccaggggataggttcgtgtttagccgtatctattcccatccattgtgccatctccggatatttttcttcataaggggccacaccatcggcaggatgtagatttagggtaatctttaagtcattgtctttcagataaccgaggaatttggcaggatccggaaagagtcggcgattccatgtccatcccgtccatccgccgaatcccggttcggtatagtgccagtccatgtctaccaccaatacatccagaggaatattataagtgtggaagttgtccaccaattgccgcatctccttgtccgaataactccaatatcttgaccaccaatagccgaatgcgtaccggggtgggagaggaacttttcccgcaaaggctgtataatctttcagggcagctttgtagtcgtgtccataggccatgaagtaccagtcttgtccgtctttattttcacgtgtctctacccagggccattccgaatcatcaaacaggaaattttttgaatcgtcaatcagagtccatccgtctgttgagagaagaccgtcttccagcttcatgtcctgatggctgtatatgttgtggtttccttcaaaaccatccagtgtgcggtccgtccctttcaggtttcccttttgcgttgtaccgggtgtccactcgaagggcaacattcctttggccgatgtaatcgttaaattatcttttgtaaaaggaccttttccttttttatatttcaatttcatacgggcggtacttatcactaccaccgcacttttattttgtaccgtgtactccggaatcggtaagttacggtggattgctacaaatgatggggcgtcggtaaacgtacccgaaggactccattccatacggataaccccatctgtgagaatgctaaaacgtacgttcccatcacaataggctattgtgttctgaggagttgctgccgagagtgaaaggctgaacagaactccttgcaatgccagtaaaaaatagactgctaaatatttcatgttgtatttatgttagtttttcacaaagataagagtaatattcatatattcgtaataatgaattttaaatctttttatatctttgcaacctgtgcaataattatcgttcctttagttacaacagatgatagtatgaaaaaagacgatttctcagaaatttatgatgtttattttccgaagttactgcgttttacccaaacgtatctgatttcagaggatgaatcggagaatattgtccaggaaatctttatctatttatgggaacacagagatatcatcgaaacacttcagaacctgaatgcctatctgtttacattggcaaaaaaccgttgtatcgactattttcgtaaagagatggttcgtgatatccgtaaaggttcgctttcggagatagaaaacagggaactccaactgaaactatattcattggaagcatttgacaacgatcgcctttcggatgctgacattgaggagatattgaataatgccatcaatcgcttgccggagcgttgccgtgaaatatttattatgagccgtttgcagaatctccgctataaagagatagctatacggctgaatgtttctcccaatacggttgagaatcagattgccatcgcattgcgcaagttaaaagaagaactgaaagactactttcccctttttgttttcattatctgaaaaagaatccctatttttgtcaagttattaggaattacttattttatattcaaaacacaacaatgaaacacttagttatttgcatcgtcctgatggtgggcggtgcttgctgctttgcacagcaaaagaaagtggctgcccataaggccacgagtggtaatcctgtactccaggggtggtatgccgatccggaaggcattatttatgatgatacttattggatctttccaacttggagcgacgtttacgaaaaacagactttctttgattgtttctcttccaaagaccttgtgaactggaccaaacatgcttcggttctggatactacagccgttaaatgggctaagaaagcgatgtgggctccttcggtgattagtaaaaatggaaaatattatttcttttttggagcgaacgatgttcacgaaggagagattggtggcattggcgtggcagtcagcgatcgtccggaaggaccgtacaaagatttgctgggcaagccgttgattaatgagatagtgaatggagcgcaaccgatcgaccagtttgtgtacaatgatgacgggcgttattatatgtattatggtggttggggacattgcaatgtagtgcagttgaacgatgactttacaggattggtacctttcgaagacggtactatctataaagaagtgactccggaaaattatgtcgaaggaccgtttatgttcaagaaagacggcaaatattattttatgtggagtgaaggaggttggggaagccctgattactctgtagcttatgctatttccgattctccgttcggtccttttaaacgtgtagccaaaattctggagcaggattcttcagtggcaaccagtgccggacatcactcggtgttgcatgctcccgggtcggatgattattatattgtttatcatcgtcgtccgctgaatgataatgcgcgcgatcaccgcgcgacttgcattgacaaaatgacttttgacaaagacggatttattaaacctgtgaagatgacttttgagggtgtacctccacagaagatcaagaagaaataaggaaatcgtttgggagatgtgccggaaacagaatggcacatgaacaaagctggttttgtaaacggccgcagatgctgactttttcaaactgtcgatgacatttgaaattgcatctgaggccgttttattgtttgggatcagtagggtgtcttcgggcaaatgcggtgatcgttaagagtgagaaagtacattaagaagtccattgcttgatgggatgtgcttctttatgaagtggtgaagtcatgactgaaaaatcttctggtctgcatgtaaagttcatcttagccgctaagatggacatcttggctgccgagatctgcatcttggctgctaagatacacatcttgagtgctgagatggacagtatgatatggagaatcccattttctttagtattctgacgaactttgatcagggacttttgtgtgtttgattttaatcttgtgatgggcttgttcagaagaggtttccggagagggagaggtatgaaccgatgaaaggccgggacaggggattgtgatgctttattctggctgcacgggtctgattgcaaagaaaaaaagttttttgaaaaaaagttgtttttcttttagtggattttaaaggctgttacgccttattaatagaaaccctaaaaaatgaatgaactaatagataaatattttgcaggagaaatgactgaccgggagaaaaaagaccttttcgaccggatagagacggatgaaactctgaagaaagaatttctccggatgcagaatgtagtggcgttgaccggaatactctcccggcaggacgatcctgaagtcagccgaaaagggaagcagcatttcgcgcaactcctgtttcgtaaaagattgaagcggacaattatcgtatctttgaaatatgccgctgtttttgcggtgttgattgcaggtactttctatgtcacaaagcaatacttgtcagaggaattcggtaaaaactatactatgattacagctcccaagggacagcgggtaaaagtggatttaccggatggaaccgttgcctggctgagtccttgcagcagtctccgcctgtcggcttcttttaatgagtcggaccgtaaagttgaattggatggcgctacttattttgatgtggcaaagaatcctgaaaagccgtttatcgtttcggccaagggctatcgggtcagagtgctcggaactaaattcaatatatcggcctataagaatagtgctgaatttgagacggaccttgtagaaggctgtgttcatatttatgatccggcagatataaggaatgaagtatttctgcaacccaaagagaaggcggtgctgtggggagaccgtctgatgaagcgggaatcggactttgataatgaagaatatctgaagaacggaatagtgagcttcctgtcggaacctttcgggagagtgctgaacagcgtcgctttatggaatgacgtaaatttcaagatagaacgttcggtcaatgcaacccaacgcatttccggtaaattccggcaaagtgattctttggagagtatcttaaaagctttgcaaggtgccatgcctttcaaatacaagatagttagtgaagaagaaattattatttattgataaatacggatgatactctaactaaaaacagatgcctatgaaatagaaaaacagtatgaagtgaaaaaaaggaggaaatggtctggtacacctttccctcccgataaagtcaacacatttggctggtcctaataaaaaacaacaaagtattaaccttattacattgcaaaagtatgaaaaaaaacttattgctgttatcttatgcaattaaacaacgtgaaattattcaaatcttgcgaattatgaaatgcacagtcttgctattatttctgcttatcctccaggcacatgctggtgtaagctcgcaaaatgcaagggtaaacatgtctcgaaaccaacttccgttaaaggagtttatggcggaaattgaaagacagacagactatctgtttatctatagtgatgcagaaatcaatgcttctcgccaggtaagtgtgaagaaaggtactcatagggtggccgatttactgagcgaggtgctctctaagaataatatttcttataatttcgcagataattatatttctcttcatgtacgcaaagaggctgaagcacagtctttggctgcatctccccaacagaaaaagaatacaattcaagtatcgggaaccatcgtagataccgcaggtgagcctataatcggggctaacatcaaattgaaaggtgctcagggaaccggaacgattacgaacgtggagggtaactttaaattggaagtgcctaccaatggtgtactgatcgtttcctttatcggataccaacagcaggaagtgccggtgaacggaaaaaccatgctgagaattaaaatggcggaagacgcagaagtgcttgatgaagtggtggtaacagctttgggtatcaaacgcgaagaaaaggcattgggttacgctgtccagaaggtgggtggaagtaagttgtccactgtgaaacctgttaacatcgctacttcactgaccggtaaggttgccggtctgaacgtaaccaacagtacggagttcaatacggctccgaccctcaaactgcgtggtgagactccgttattggttgtggacggtgtgccgtatagcaatatttctctgaatgatatcgcggcggatgacattgagtctgttgacgtattgaaaggagctactgcatcggctttgtatggtgcccgcggaggttcgggagctatcatggtgactacaaagaaaggtagccaggaaggactgaatatttcggtaaacagtagtacgatgttcaatgccggctatctggtgttgccggaagtgcaacacggatacagtaccggtcagggaggtaaatataccgctgccgactttgtttggggtgataaattggatatcggccgtactgccgtacagtatgacccgtatacttatgagtggaaagagatgccgttggtttcgaaaggtaaagacaactttaagaacttcctggaaacaggtttcatcaccaataacaatatcagtatcagccagaccggtaaatacggtagtttccgctcttctttgtcgcatgtttataacaagggacaatatccgaaccagagattgaataagattacttattcggtaggtggagacatgaagttcggcaaactgagtttcgaaggaggcgcgatctacaacaagcgtttctatcccaatggtgaaggagccggttatggcggcggcggttacatctacaacctgttggtatggacaggtaccgattatgatgtgcgcgactataaaaactattggagaaagaaagacgaagaacagaactggatgaatgacgtgtggtatgataacccttattatctggcgcatgaaatgacttcatcgaatgattatgataaagtaaatacttacttgtcgggtaaatatgacatcatgccctggctgaacttctcaatgagagccggtgccgatgcttatgccagccgtacggaaaagaaaaacgcaatgagtgcccgcggcggatgggacaagaacggatacttctatacatccaaatctaccggattcagtttcaatggtgatgccttgttatctgccaaccacagttttggcgattttgccatcgatggttttgtcggaggtaccatctattattactatgatgatgccatatcatcgaatacccgtaacggattgagcattccgggctattattcgctgaaagcatcggttgatccgattgcttcttcaagttcatacaagcaaaaacaggtgaattctatttacggaaaattctctgcttcctggaagagcaccgtgtttgtggatgttacggcacgtaatgactggtcgtctactttgccctcggaaacacgttcttatttctatccggctgtatcgggaagtatcatcatgtcgcagttgctgaagatgcccgaatggctgaacttctggaaactgagaggtgcctggactgtaacgaagagcgacttgggcatttatgatacgaatcaggcttacagtgtaagcaccaacgtatgggacggaatgaatactgccgtatatccggaaatgattcgcagttcaacccttgaaccgactgctgcgcgttcttacgaaatcggtactgctttcaatgtatggaacaaccgtttgcgctttgatatttcttattataacaagctgaaatacaacctgacacgtgaagctacaatcagtggatcgtccggttttaccaaaacattggtgaactatgatgaagagcaggttcgtcggggagtggaagtttcgttgacagcatctttgatccaatcaaaagactggaattgggaagtgaatgctaactgggcccgtgaccgttacttctatgctaaggttgacccggtgtactctacacagaaaccttgggtagctgccggtaaacgttgggactggtatggcatctatgactgggaacgtgaccctcagggaaacatcattcatgaaaacggttatcccgtacaaagcaaataccagtcggtaatgggtaatgaatatccggactggatctggggtctcagcactaccttgcgctataaagaatggactttgggaatctcgctggacggacgtgtaggcggtatggcttattctcgtacggagcagaccatgtggaacaccggtgtacaccccgatagtgataacaaatggcgttatgatgaagtggtgaacggcaaaaagaactatgtgggccagggtgtgaaagtggtatcgggtaaggttgaatacgacacaaccggaaagattatcagtgatacgcgtgtgtttgcaccgaacgatacacaggtttcgtatgaaagctatatcaagaactacaatccgtggtcgggtggcaaggtttaccagaacgttcacgactgtacattcctgaaattgcgtgagctttcattgttgtacacaatgcccaaatcagtatgtgataaactgcatatgaaaggcgttacactcggtttgatcggacagaacttattgatctggatgaaagagtttaagtatgctgacccggatgtggattcggacgacctgaattcaccttctatgagatatgtcggatttaatgttaagtttgatttgtaaaaatggaaattatgaaactaataaataaaacgttgcttttacttacagcaagtgccgctatcctggcatcttgtaacaagtttgatgatttgaatacgaacccggatgccgcaaccaaggtgacagcccccatgttggcgacaaaacttatcctgaatatcacacaacagggtgctgcaaagaattttgtataccacagtatgctgagcaagcagatcgcatggtcggagaatgcttcggatgaacagtacaatttgtttggcagaaccgattttgacggttataccattctcacaaactgccagaagatgattgatgcggccaatgatggagataaggactcgtatgctgctttggctaaatttatgaaggcctataagctgttctataaatcattggaagtgggcgatatcccttacagtgatgctttgaaaggcgaagagggagttcagaagcctaaatacgatacacagaaagaggtgatgcgccaggtattggaagatttggaagaggcttacactttattctcatcgggtgatgactttgacggtgaccctatctttggcggtgacactgaaaactggaaaaagaccgtggttgcattcgaactgaaggtactgacccacttgtgtaagaaagaggcggacgcagacctgaaagtgaaagaacgctttgcccgactggctgcctcgggttcgctgatgacatcgaatgcagataacttccaactggtatattctaataaggccggacagctttatccgttctactatacacaaaacaagcattctgactatctgatgatgtcgagcgtgattatcgataacctgaaaaagttcaatgactaccgcatgttctattatgcttctccttcgaaagcccagacagacaaaggggtgaaagagtccgagtgggatgcttatctttcggtagatccttcggacagctattcaaatatctctgtcctgtacggaaaaggtgaattctgcctggctaaccttcgctatacccgtattccggagggggaacctctgatgcgcctgagctatgcggagcagaactttatattggctgagggagctgtacgcggctggatttcgggagatgcttctacttattataagaaaggtatagaagccagcatgaattttatagcggacaacacgcctgataaggaagagtatactcatggacgtaccattacccaagagtatatacaggaatacttggcacaatcggtcatccagttatccggtgataaggaaaaagacctggagatgatcttattgcaacgttatctggcctcgttcctgcaacatccgtatgatgcttactatgactaccgtcgtacaggatatccggtattgcctatcaatccgaatacgaacctgaatacagaaaaggataagatccctacaagatggatgtatccggaggctgaattcagttataatccggataacgccaacgaagctgttcagcgtcagtacaacggttcggacgatgtgaataagttaatgtggattctccagtaaattattactcatttgaaggtaaacgcacaggtatatcctgtgcgtccttctttatacccaaataatcataaccatgaaacaaatttatttattgctggctatcctgttgggaagccttcagctggcaagtgcacagcagcaaactctccggttcaacaaagacggtaaattcaagattgtccagtttaccgatgttcattatatctataatgactcccgttcggacatatcggttgagcgtatcaatcaggtactggatttggaaaaacccgatcttgttcttttcacaggtgacgtgatttatggcaaacccgcggaagaagggatgcgtacggtattgaatctggtatctaaaagagagattccttttgccgtaactttcgggaatcatgataacgagcagggattgacccgtgaagagctgctgaagattatccagtccgttccttacaacctgacacagaccactccgggaatttcgggggtgaccaattttatcctgccggtgaagtcgtcggacggaaaacgcaatgcaacggttctttattgcatcgactcccattcttattcacagataaaaggggtgaacggatacgattatatcaaatttgaccagattcagtggtatcgtgagaacagtaagaagtttactgcggaaaataatggcgttccggtttcgtcgtatgcattttttcatatagctttgccggagtataatcaggcagcctcttccgaaagcgcaatactttatggtattcgtaaagaaaaagcatgtgctccccagttaaattcgggcttgtttactgccatgaaagagatgggagatgtgagaggtgtatttgtgggacacgatcatgatgacgactatgctgtgtcatggaagggcatcttgctggcatacggacgttatactggcggtaatacagtctataaccatctgacaaacggtgcgagggtgatagagctggatgaaaacgcaagcagcttccgtacatggatacgcctcaaagaagggattgtacaacaggtgacctatcctgccgattttactaaagaataaaggttgcacaaaagcatgatgcgatatgacactgccgccacgatgggatatgtttttggagtgaaacagccgcaagtttggacaggacgtccgatgatacaggttttcaagtaaacagtactgtcacaacccgaagaaaaacaatgcacataatataaattggataaaatgaaaaagattttttttatgacgcttttcctgctggtaactatggtggggcaaagtaaaggtaaaggtgaatttacggttctgcaatggaatgtatggcaggaaggtacaatggttccgggaggatatgatgcaatcgttaacgagattgtacgtttgcaacccgattttgtgacgttcagtgaagtacgcaattaccataacactcgtttcaacgaccgtattgtggcttctctcaaagagaaagggctggattattactctttctatacttatgacacaggcttgctgagcaaacgtccgatcacggattcactgactgtatttccggaaaacggagatcacggaagtatctataaactgaccagctcggtggacggacataaagtggctgtttatacggcgcatttggactatctggattgtgcatattacaatgtgcgtggttatgacggttccagttggaaagagatacctattccgactactgtggaagaggtgctcaaagtgaatgtggcatctcaacgcgatgacgctatcaagatgtttatcgctgaggccaaaaaggacattgcaaacggatatagcgtgattgtaggcggtgacttcaacgaaccttcacatctggactggattgaggaaaacaagaatctgtacgaccataatggtctcgtaattccctggacagtgacaacattgttggagaaggacggatttatagatacataccgccatatttacccgaatccgctgactcacccgggatttacatatccggcagataatccgctgaaagaacccggtaaactgacatgggcaccgaaagcggacgaacgtgaccgcattgattttattttctatcagggaaaggatattgaagcaaagaaagcggtgatctttggtccgaaaggctctatcgtacgtaaccagagagtacaggagacttcaaaagacaaattcctgcttccgttggacgtatggccgaccgatcataaaggactgttggtaacgtttaagatgaagtgatgtttcaccacagaagacatagagtaacacagagtgaattttaagtcattgattattgacataaatgctctgtgttactctgtgtcttaaatctccccacgcatccggtcttcgaatgctgcgagtgctgctttggcaccttcccccattgcgatgataatctgtttgtagggaacggtggagacatctccggcagcatagatccccggaacattggtgcggcagtgggagtctattatgatttcacccggacggtttacttctaccgtctcccggaaaataccgctgttgggcatcagtcctatctgtacaaaaatgccgtctaacccgatcacctgttcctgctccgtctgacggtctttgacacggatgccggtaactttgtcgccattgcctatcacttcggtggtctgcgaatggacgaagacttctacgttcggcaggcttttcagtttctcctgcaacacttggtctgctttcagttcatccataaattcgagtaccgtgacttttgagcagatacctgccagatcgatggcagcttcgattccggagtttcctcctcctacgacagccacatgttttcctttgtagaacggaccatcgcaatgcggacagaatgcaactccccggccgatgtattccgcttcgcccggtacattcagtttacgccagcttgcaccggtggcaacgattactgccggagcagagaaacgctcgccccctttggctgtgagcactttgtctttgccttcaagctcgagcttttcaagtcggcgatgttcgagcaggtcgatagggtattgtgccatgtgcgttttcaagttatcggccaactggcttccggtggttgagggaacggaaatcagattctctatgccgaccgtctcttttacctgtccgcctattctttcggcaataacggctacattcaggcctttgcgggccgaatagatggcagcggcggaacctgccggacctccaccgactacaatcacgtcatacttcctgatagaactttcacgggcgctttgttccactccatattgttcttccagtttgctcaacagttcgccaaagtcgccgcggcctacatgaatcagtttgccgtctgcgaatacagagggaactccctgtattttcaaggcttctacttcggcttgattgatggcaccatccaccgtctggtgctggatccgggcgttgagtgtggtcatggcattgagtgcctgcactacgtcgggacagttggtacaagtcagtgacacataggttgtcaggcggataggtcctttcaatgcttttacccggttgcaaatcccttcgtccgggaagtttttgccttttccgtccgcgttcagtacggcgagtagtaatgaactgaattcatgtccgttggggacggcgcggaaagtgatgcccgtcctttggtcgtctttgagaagcgtaaattccagtccttcgccctcatggatccggcaagatagtttctctgaacaagatgccacgtcgttcaaaaggtccaggagttcgttgcggctttcgtgctgtggtgagacagtgatatcgaatgtgtacttcgcctccaatccggagaagatggtacgtaattgttcttttatagctgagtctaacattatattgaagattgattagggtaaaaaagaccggcattgggggatgccggtcttcatagaattactgcttagatcttaccgaccagatcgatgctcggcttcagggttgcttcgccttttttccatttggcggggcaaacttctccgtcgtgggtagccacaaactgtgcggcttctactttgcggagtaattcatcggcattacgtccgatgttgttgtcctgtatttcggcaatcttgatctttccttccggatttacgaggaaggttccgcggtaagccattccgtcttcttcgatcatcacgccaaagccacggctcagtacgcctgtcgggtctgccagcatcggatatttgatcttacggatactttccgaagcatcatgccatgctttgtgtacaaagtgggagtcggtgcttaccgagtacacttccacacccatagcctggaattgctcatacttttcggcaacgtctaccaattctgtcggacatacaaatgtgaagtctgccggatagaagaagaaaatagcccattttccctttacgtcttcgctgcttactgttttaaaacttccgttttgaaaagcctgtactttgaattcaggcatctgtgagttgataattggttccataattgtttcttatttagattcattctttatttgtttacgttgcaaaagtatggcaaaatttcccgtttcaacaaaaaatcccattgataatatttatcggctgatagatgaaatcttatggggtatgcagctccatgtgttttttgcctggtataaggacggaatgttcatattgtaacttatttctttagttctcttccggaaagaaagtaaaaacgctgattggctgacaagccctttggagattcggatcaaaccggcgggagcgaagtgcaaaaactgagttttttttcctcaagaagcaggcttgggcggtgcgaaagccggtgttttcatccaaaagagccggtgtttccggaaaaagaagtaagcatttggtccgaaagacgtaagcaacttgagaaaacgcttacttctttttggaatatctctatatgttttctctcattacatatattgttcccgtttgagagatgaaaagagagagatttttttctggttgacctttgattatgaaggtgccgaaacagataaaagggaagtgccggacttaaataataccctttttgttcttattcttatagaataagtgttctcttgcctgaaaatagagattaaaggtgataaaacggaaaaggctgactgggaaaggagacgaaaaaaacgttctactgcattcttgcccggaaaaaagcaaatctgggtccattcgattatcaatttgacagaacggcattttaaagccttcgctgtggaaagagggagggaagggtgcttggaagagaaggtgatatgaaagcaaagagagcgcagacaggtgtagtctaatcaaaatagaaataagtttgcgttttgttaaagttgtattcacgtttaaacttctatctgactttttagtcatatagacagttgcaacaaaaaagacagatgattatttgataatttaaaaaagaaaagaacaatgaaaagaataagttttttgttagtggcccttttgatggtagggggaatggcgatggcacaaggcccgcgcagaggtggtcagaatatggatccgaaggaacgtgccgagcgcatgactgaacgtatggcgaaagaatactctttgaatgaaacccagaagaaacaactgttggaagccaatatggctctgatggagaagatgggaacacgtcccggaaagatgaaacccgaaatgaggcaaggtaaggaggggcagagtcaggctactgacagctgcacttgtaaacaggataaaagaaaagctccccgcatgtcgaaagaagacagagaaaagatgcggcaggagatgaaagcttcgcgtgaggcttacgatgccagtctgaagaaaataatgacgaaggagcagtatgaggcctataccaagcagaaggccgaacgcggaccgaaaagaggaggtagaaagtaaatttcagtatggatgatcagtgatggaccggcgtagcggtatagggcgccggttccttactaattgtcagctactaattaccgaaatacttgtatatttccactgctttttgttcctttgccgtacgatttaataaacagatgattcaaatatgaaaaagcttatttatctgcttgggttgacaatgcttatggttatcgttgcgtgttccggtacagctgaaaagaaacaaagcgatatccgtgtcttgatgcaagatagcaccgatgcacatggtttgcagcggatgacagcccggaagagtgagatagatattaaatacaaaggcaaagagtaccattcgtttatatcccgtacccctaatgattcacttcctcgggtagtgagccagatgggaaatacatacgttgacaatcagattgttctgaggctgacacgcgggaatgaacgtatttttagcaggactttcaccaagaaacaatttgcgtctctgataggagaggactttatggcaaagtccattctggaaggaattgcttatgataaaacaactcccgagggatttgtctatgccgccagtatctgttatccgcaaacggacttgtatgtgcccgtctccattacgatctcgaccgatgggaagatcagcatgaagaaagaagaacttctggaagaggtatacgaggaggatacttctggccgttaaaaaatacaaaaagagtttacccttttgtttattaccaaatctttcccgattctatctcgttatttgcagtgtaaaataattccgaaacttattatttacactaaaaataacgattatgaaaaagattctatctattcttgttttggctatcatagccgttcaatttgcgtttgcaggtgatatcattacgaaagacgtgatgacgctgcctcttccggcacgcaactttattaatcagcacttttctaatccgcagatttcgcatattaagatagaaaatgagattctgcaaacaaagaagtacgatgtgttgttgactaatgcaaccgagatcgacttcgataaccggggaaactggattgaagtggattgtaagaaagccgctgttcccgcatcgattatccccggcttcgtgaaggagtatttgaagtccaatggatataactctgaatttgtaactcagatagaacgtgaccgcagaggttatgaagtcgagcttaatacggatttgagtctgaagtttaccaaagacggccgtttccgtaaagcggaatattgataaattggaataaacctgttaaaaaaagaccttgattatgaaatcgttgaaatttagtttgttggcagctgtgctgctgtcggtagtgtttgctttcagttcgtgtggtgatgatgacgatacaggatatcttccgccgagccaggccattcaggatgcactgaagaagctttatcccaatgccactgccattaagtgggagcagaagggtgtttattacgtagccgattgtcaggctgacggcagagaaaaggaagtatggtttgatgccaacgccacctggctgatgacggaaaccgagttgaacagcatcaataatctgcccccggcagtgctgacggcttttatggagtcgagttacagcaattgggtggtggatgatgtagcgatactggaatatccgaatgaaccttatacggaatttgtggtaaccgtggaacagggtaagaagattgatttatacttttcggaaggtggcggtttgctccacgaaaaagatgtgaccaacggtgacgatactcactggcccagaacttaaaggttgaatctgccgaccgaggcacgtgaatagaaagaacaagaggatgtgcaatctgtggtgagtcatgcacaccctcttgcgctttatggagaatggccttttacatcggcttgtaatcctttgccagtccgccttcgcttgtttctttataaagtgaagggaggtcgtggccggtttgtttcattacctgtattaccttgtcgaaagagacgcgatgtattccgtcggtgaatgacgagtatagattggcgtccagtgcacgtgcggctgcgtatgcgttccgttcgatacaggggatttgtactaatccgcacaccgggtcgcaggtcatgcccaagtgatgttccaaacccatttcggcggcatattcaatttgcgcaggactgcctccgaacaattggttggctgcggccgaagccattgcgcatgccacgcctacttctccctggcaacctacttccgctccggatatggaagcgttctgcttaacgatgttgccaattagtccggccgttgccagtgcgcgaagaatgcgcatctcactgaaatcacggctcttggcaagatgatagagaacggcaggcattactccgcatgagccgcaggttggtgccgttacgattttacctcccgaggcattttcttcacttacggcaagtgcataggcaaaaaccagtccgcgggattgcagggaagctttgtatccggtggcccggatataatatgtggaggctttgcgtctcaggttcaacgggccgggcagtactccctcttgttcaagaccacgctggacggactctttcatcgtattccatacttctctcaggtagtcccatatatcgggatcttcgcattctttcacgtattcccagtaactctttccggtgtgttcgcaccaatccagaatttcggtcatgctgttcatgccatatacttccgggctttcaatggaagcttgtttgttgtcttcggccaatgcacctccgccaacgctgtaaacggtccagttttcaagttcgttgccatcagcgtcgagcgcaatgaagttcattccgttggggtggaaaggtagaaatattttaggttgccatataagatctaccggtgctgtcggttccaatgtgtcgatgatggctacatccgtcatgtgcccttttcctgtcgctgccaggcttccgtagagggttactttgaacgatgctgcttcaggatgtcgggtgaggaacatttctgctgccttgcgaggccccatggtgtggctgctcgaaggcccggttccaatacgatagagttcttttattgatttcatattagctaattaggttgttgcgcaaaggtaattgttttttcaagatttttggtaacttaataccatttcttcttacggaaaaaccagtatacggctgcgcctaccaatatcatcaatatccaggcgtatacatatccataccgccagtccaattcgggcataatcttgaagttcattccccatacaccgacaagaaaagtcaacgggatgaagatggtagaaacaatagtgagccgcttcatgatgtcgttcatccgcagatcattgttcgatatataaaggtctaccaaagacgataacgtttcccggcatatttcgattgtttgcaatacgaattgcagatggtcgttgacatcattgaagaaggcacggttcactttgtgcatcagggagttttccgccctcagcagtttgacgtattgttcttttaacggaagaatggcttttttcatcagcatatattgccggcggagtgcctgtatctggatgccgatgtcgtttccgtcactgatggtgagtagttcttcttccaggtcttccagcgagtcgtcgatggtggatacggtggaaatgtagtttcccatcacgctgttcagcaaaacactgagcaggtagtcactttgtcggctccggattttcagtacgtcattgtgcagggcggaggtaacgtcatcgaagaagtcggtttcattttccagaaaggtaagcacaaagttgctcccttgtatgatacacacctgttgctgctccaattcatccatctcatcttcggggcttgtttcttctctgttgttgaagcggaatattttcatgatcagtaccgtatacttgtcatgctcttctatctttgtgggatgttcggcattcagaatatcctgaagggtaagaaagtctatttcgaagtggctgcatatttcgcggatgagctcggtattctgaagcccgtgtatctgcagccagttgatttcttcgtggttgagtgcattggctacagcctggaaatcggtgcccgatacttcctgcatttcgagggcattgtaggtacacaaatgcaggtgagtgggagtctggctctcaccggtataaactaatctttcacttaacaggttattcttcatattctttgttcttttatgccaaatcgactaccgtgatacctgctcccccaaattggacatgctcgtcggcgaagtgacggatacccggtacggtttgcagatattggcggattagggtacgcaaaattcccgttccggttccatgcagaatacgtacccggctcataccgaccaggatggcgtcatccacaaaataggtaacagcctgtaaggcttcgtccccccgcattccccgcacatcgatatcttgcttgaagttcagctttttctcgtacatgctgtcctgggtctggttgctgacaaaagtacttttagcaggctcctgtttctgaggagttgcattgcttcgttccaaccgttccagctttacggttgttttgatactgccgaaagctacgactgcattctttccgttgatctcaagcacttctccgacagaactctgccctttgatgcgtaccggacacccttcggtgatgggagctacttggggagtttgctgtgcagcttgttgttctttcggaacattctgctttttttctttcttccggttttgcttttctttcagcttttccatctttcgggctatcttgtcctcctgttctttggaagtcaggctgtccatcgactcgcggaactctgccagttcctgacggacgaggcgtgtcttttctttttcagcctgtgcctctttaatggtacgtatggtgttctcgatacgtgcgttcgattcttgcaataaccgttcggcttcttctttggcctggcggatgatttcctttctcgacttttgcaactcttccatttccgattgataacgggcgatggtttcttccatctgtttttcacgttgacggatggtctggcgtttgccttcccaataacgcttgtcccgcacaatgtcctgcaagtatttgtcagcattgatgtactcgcttcccactatttcggaagcatcggcaatgacatcttccggtaaaccgattttccgggctatctctactgcgaaagaacttccgggattaccgatttgaagttggaacagtgcctgcatcaagtggcggtcgtagagcatagctccgtttaccacaccttcatggtcttctgcaaagtgcttcagattttggtagtgtgtagtaataacgccgaaagtatgctttatgttgaatcgtttcagaacagcttccgcaatggccccgccaatctggggttctgtaccgcctccgaattcatcgatcagaattaggctgcgttcattgcaactcttcatcatgatcttcatgttcgtcaggtgggaagagtaagtgctcaagtcgtcttcaatggattgttcgtcgcctatatcgatgaagatgctgccgaacagaccggcgtggctgcgttcgtgcataggtaccagcataccgcattgtaacatgtattgcagcagtcctacggttttcaggcagactgatttacctccggcattagggccggatataatgaggatgcgctgtttggtactcagttctatatccaggggaactaccttttttccgtgcttggcaagggataattgcagcagtggatgaacagccatggtccaatccagtaattgttcgttttccagactgggcttgatgctgctggtttgaatggcaaagtaacttttggcgcgaatgaaatcgatttcggccagaaattcgtacgattggagtatctccggaatggaaggacgcaatgtattggaaaatgtggtcaggatacggatgatctcgcgacgctcgtctccctccagttcgcggatgcggttgttggcttctaccacttctgccggttcgatgaatacagtcttaccactggccgattcatcatggacgatacctttgattttgcgtttcagacccggagcaaccggaattaccaatcgaccgtcgcgcatggtcggagtaacgtctttatccacatatccgtccgattgagcgttacgcaggatgctgttcagcgagcgtgaaatactccccatcgtattagccaattcccggcggatgcgtgacagttcggtcgaggcgttgtccttgattttaccgtatttgtccagaatgccgtctatcttggtgataagttgcgggaatacggcaatatctcctgcgagtcttttcaggctggggtaagggtggtcggattcttcttcctcgttccgttgcagaaaacgtacgatgtcgcggattgtctctaacgaacgccgcaagtcgaacagttcctgttcgtccatgtacatgccttctacccgtacccgttttaatgacggacggacatcgaagaaaaactgatccgggaagttatcttcttcttgtatgatgcggacaaactctgtgacttggttcagcagttcttcaacagtttcaaattgatcggagaagttcatttccgatactctctcttctcccaacgtactgagacatttgtcctttaataattgtctgatctggtcgaatcctattttttgctcaaaattctggggatatatcatgtactgtcttatttatctgtataacgctttaagttgaaatgtgccgcaaaaatacgattatttcgcgaaaaaaatgccgaaacgtttgcagatttgaaaatgattcgtacctttgcagcgctttaagagaaaagcactattgaaaagtagttttggagaggtggcagagtggtcgattgcggcggtcttgaaaaccgttgtactgcgaggtacccggggttcgaatccctgtctctccgcaataaatgctgaaaatcagtgatttataagaaaaacacccaattttacaccctaaaaagtaaaattgggtgtttttgctttatttaatactttgttcttttattacttatttggctttgcactgtctttggttgcttaactattatttattgtataatttgaaaaggggatattgtgttgttggtgatattgttatactaatatttatttgaatcattttctttctttaacttttttagagtagggaatctcccgaataattctgtcttttataatagtaatacattcctttagagcttgattttgtgttattctgtttgtatcttggtgctaaacgcattatttttatattggataggcatttaggttatgaattgaatataactttgggcttttaaagtacatttcattttgtcaatgaaatactaattaatgggtattttactgataaagaaatttgtatgattttgcataaatgcatatcgcaaagatgcaaaaacgatttattttattgtgttgatcgtggatttgtttacagctcttgtatgttatacttttattttcatgctttgggcataataatgaaattgaatggttatttgtaataaaataccaattaattggtattttattgtacaggagaaatcctttaatttgcaaaaaactaaattgtattaatatgaaaaaaatattcattcttctgttcgtttccttagcattattttcctgtgaaaaagaagaaaataataaaatttttaaatatcagttgctgccaagtgagaacgtatctaaaccatttagttgtttgggggagaaacgtactattacttttacaattattcaaaaaacattgatagatgatattttagattcagaggttccgattattcccaaggatgtttcgatagaatttgataaaactcttttttctgatatagagacaaaaataaagggtgatcaagttgtattaaatataacctcaaatattaataaggaagataaaattttgaatgttgatctacagatttcttactctactattaatggtataaaagtagaaaaaattcccctaattatagataaagggaagttgacatttgtgtataaaatccattcggaacagaatccttttgttctaccagctgaaggtgggaaatttgaattgccctttatttgtaaaaaacaaacatatttgaatgatcagtttatagaggaaacttattcatcattaaatggattgagatttaaaacgataagtactggtaatgtctggtttcttacggtcagaaaagacggagcaaaaataggtttttacaaattcacttttgtgggagaaggaccatataaccaaaaaacagacccagagtgttattttaatatatatacccatgatgcaaatttaattacagataatcctacggaaatattcagacaggatttcatacaaccccagaccccgggtgaggattattataaaccttctcgatcctcttataaacatggtacttttgatttttaacatattcagtattaaccttaattatattaattatgaaacagtatgtatatttgttgattttgccaattatgtttttaatttcatgttccgatgatacagttgaagaaatgggtggctctaatcatgttcttcttgagagataccctcaagaagtgataaatatttcaatggataatccagaaagctttgcttcatttaataaaacctccgttactcgttcttctgaattattgaaagatagtgtatggagtagtggaaatggacatacattaatttatgaaacaaatgaacatataccaactcaagggttaatgaggtatatttatttaggttcaattcttcaaggtggatctattgaaaagcagcgctttgttcctattgtaaaacctatggatccaattacaatatcatattcttttccagctcgttgggttactgatattatcgcaaaaccgagcctttcagcacaaaggcaatctttgcagaatataatgaataaagaaggcatgacaggtaaacagttggggtcttttacttataatatgaggcaattttcctattttgaagagttaaaacttgcttttggagcaaatgtcaacataggcgggctccttaatattgatgtcagtcttgataagggaaaaataagaaagaaaaccggattgtttgcgaaaatagtacaacgtaattacactgttgacatggaccttcctgctgatggaaatattcttttaaatcatgatgatatgggatctgtcggtaagtatgatcctatttatatcagttccattacttatggaagaatggccttaatttcgatagaatcttctgaaagttatgataaagtaagaattgccttacaagctgccttacaagctaaagttgtaaatgggaaattatcttttaatcttgaacaagaaaagattcttaaagaagcagaggtgaacgtcatggtgtataatggagaaggagaaggcactgttaaaactgcgaaggggtggaatgagtttcaagattttataattcaaggaggtcgattttctaaagacctgccgggagatgcaattttttatactgcgagttatttatctgataactctcccttctactccaaatttaaaatccatttagaaaattgacaataacttagaaccatgagaatcttaagatatactctgtttttatttgctataggattaatttcatgtgaacaagaatttgacaaaaaagaacagcaatctgattgctgttcttttcaaaatctacctaagtatcccgaacaagtggtgaatataaatgtgcataactatattcctgatatgggagataaggttttatcttctccttcgcatatccatacaagagcttcagaaatcatttctgagacattatgggataatgggtttggtaaaacaattcatgcacaggcagatgagtcgatagttttggataatttgaatcgatatatttatcctggctctatcttggatggggcaagcgttgccaatcaggattataaaacaatcagtgtccactataagcctataaatgtctctgtgtcctttcctgcccaaaaagttacaggtgtacttgaaaagccctctttgtcttcatgtaggcagttggtaatggatttgatgcatcagaaaggtatagggcaacaatcagcttccgtacactttgatatacaccgttttacatcttatgatgagctgaaaatgacttttggatcaaatgccaatacgagctttttattttgggggtcgtcatcttcccaacaagaacataaggaacgaattagtaaaagtagtggcttatatataaggtttattcagaaatattttacgattgatatggatattcctgagaagagttttattgaaggtagtatcaatgcccaatactctcctgtctatgtgagctccatagcttatggaagggtcggcatattaactcttgaaaccgatgaaatatacgagaatgcggagtccattgtaaagaaggccgttaatggctttttatataacaaaaaagaatttctgacagttgaagaaaagggcttttttgatgaggccagaatgaaagtatatgtagggggaggaaatggtgacagtggtgtaaagacccttaccggatttgacgattttatcaaatttataagtgaaggagggcatttttctgcagagacacctggtaaacctatattttgcagctttgcgtatttgtcggatcattcaccttataaagttaaatttaaaattgatattgatagcgatcctgtatatgcaagaattgaatatcggaatctaaaaaatgactcctatgtaggtagatctttacaaagagaaaagataattggcgatgtacatcttgccttttatgctgatagaacggctaagattccgacagttgctccaagatacatttcttttaatattgtagaacatagcagacattatttgaaggctcgaataccaagaacagaaaaggatgatacagcagtagaagaatttgttaagagtaataatagccgtgggactgaattacaattaaaacatgatttgttgctcacagaatttgtttggacgcataataacccaagaagaactcgatatgaacaaaacactttcagatatagtcttagtgaaggtggtttttacaaaattctccctgctataaatgagccaaagaagtggcgataatttgaagttagcactccttgtcggacaaataaataagagatatggtattaaaagataaattggttatgaaaaaagtatgtatgttacttctttggttatttatatgcaatattgggctggtattagcacaaggaaggagattcgaatttgaattaggagccaattatccaattgggctacaaaagaatggatataaagaaaatcatgttgggttttatttaaatggaatatataggtttcccaccaatccgttaagtgtaaatctaaaattaggttatgaaagttacacaattgtactgaataatacttttaatggaagatctttatctcttatgccggcagctaattatcatttcttacggaatgaatctgttgattcctatgttggtttgggaactggtgtttcaattgataatatagatgtgggagttttcaatgaaggttataagttgcactttgcggtggctccacaagttggtattagatttataaaccatataaatgtatatttacagtattatgtgacacataaagatttttccaggttggtattgggagttggttatgttttctgatattgtccaagtgaagaatagatttttttatatttgttagatttagggtgtcaatttgcgtttaacaggtgccagtaaagagtatattcttttactggcactaataatttatagcctctcgttattaagtaattatattttcaatccttttcgttgcttgttttcaacaggtgtgtttagccctaacttttctttaatttcctgaaatttcttcctgaaccaatcgagtatgggtattccgtcaatgcacagcctgaattttcctttctcctgggggttcctctccactgttgccgttgagtgctccgtcctgaacttctccttgtactcctttgaatagagccttcccttgaactccacgggttgcaggctgacaattcgtcttgtcagttcttcggtgaagcccacttcccggcattgttctgctatgggtatcagttcctttacaataggaaagtaggtgtctatcagttccagccgattgtcgtattctgcgattttctgccggtagctccggtcaactctgtttatctcgctgctgtgacggttttccatttttgtctgctccctctgttcggcttgcacctgcttttgcagattcacaatgttccgtttcaaattttcattctccgcttccagcctcttaaccttgctgcctccgaaaagtgagctcaccccgtccgctatggctgtggtggcgttcaccgccgcccccttcattttctgcacgttgatttccccctttacctgcttcagctttttcattgcttcctcttccagccccagcaggttttctatgttctcttgcaggctgtcctgctgctccaccaactgcttgtagtattgcatggtggaaatatgctttgccaatgagccgtccacgcctctctgcaagccgtacttgttcatggcttgggcataagtgtcctgatagtgttttagcctgtgcctcgccattacatcatctgcgcagagtctcacgtcctgcgggttcttctttctgtactttttcttcccgttctgttcttcctgtccggctttccttcgctctccggtcactatcggtatgactgtggcgtgtatgtgtggtgtcttctcgtccatgtgcagtactgccgatacgaggttctgctccccgtatgtttcccggatccatttcagactgtcgttacaccagtcttcaatccgtccttccgcttccatttgcttcatgtccttgttgcttccggtaaggagtatccggattgccttcacctgattggcgctcaccttgcgtctgatgcctgccgtttctatccggtgggctatcgcctgcgtgcggttcctcaccccttcgggaaactgtacgagctcccggttcaggtgtgtgcgcgttctgtccgcattcttcgggtgaacggtgcgctctatgtgtgcggacatcctgctgtccgtcccttttgccttttccagatgcaaaactgcatatcccataactgtcaataatttcaggttaatacttcccctgccttgcttttatgccgcatggcagacggggtttccaaaggggcggcgcccctatggctcgttggggcttttttagcaatgtgtgcattgcgttaagaaaaagccctaatgagctatggcttttttcaaagccttccggtggctgtgcggctacatcctgatccctttgcctttcttcttcggctgctctgtctgccgttgccttttttccgcttccggtttctcttgctgccgttgcgcctgtcctgaccttttatcccgcaggaagtcgttcagatcgttgtacccttcgtatatgtgcgatgcgtcccgtatgcgtagcccgtactctttttgcaactcctgaacggcctcgattcccgccttgtcgttgtcaaggaaacaatggatgctttcataaccgcccaacggtcggattgctttggaaaggtcggaagtcgagttcagtacgatgtagtcctgtccgtcaagttcgggacggtcgggacacctttccagccgcagggtgaggaaagagaggtagtccatgaatccctcgaagatgtagcatgcctccttcgactccgattgtcgtatatgggtgatgtccttcggtgctatgcatcccttgaaatgcttgttgcgtatctcgtatcctcccgaacggttggggaagcctatagcatagtatggggtttccccggtcagatagcggacctccctgcattctctttttgccagttccgtatttattcccctttgccgcaggtaggtatacagggcgggagaggagagcggtactacctccaactgccggaaactcggctttgataagggttgcttgccaaaagagaaagagaccgggcgcacgttttgtgcctgctcccttatcctttccaagaggtagggcagactgtcggatgcgtatagctcctgtgccagtgcgatgatattaccacctttgcctgcgccaaaatcataccataggttgcgttcggtgttcaccttgaaggagggttcctgttcgtccctgaacggtgagttgtaccatagactaccaccctgttgccttaccggactgtatccaagactgtgcagatattcctctatgcgtatctgcttcgcttcattcatgttcatcatatttctgttttaagtagatattgtttttgggtttttcgcccgtaccctttcatgtgttacgggctgcatccgctttactttactttgctatatatatgcccccagactaaagtaaagcggtttccggtctgtgccgtcatggtggaggcctggtatgagaccatacccttttccgtactgtcataccgttgttcttgtcaagtgtgaatattattttttcttttcgcccgtatctttttgtatattacgggctatatccactttactttacttccgtatatatatggtacgggactaaagtaaagtggttcccatacaataccgctaatagtgaaaatcgggtttgaaggtgtatttcctgccgttctcctgtactatcatccgtttgtttttcagtactgtaatgaggtctgtcagcctgtttcccccaagcatgacaccgacagaggcgtaggttttcctcaattcttccgcaagctccttgtagccgtattcatctttgagtgtgaatgccgcttccagtgcgatgcggtgctgcttctctgtgatgtccttgtaggggtcgaacttctcctttttcccttttcccggatccttgtgtttgaacaggtattcgtccagcagttcgggcaatgcctccccgttgatgcggaatgcgaacggttcgaagttcatcgccctgatatgtgctgccttgaccgtactgatgtcggggtccttctcgtccttctccacttgcagcactgtttcggccttgttgctaagctccgttccgatgtgtccccttgcgttctcgtcccccttgttctgatgcagtatggtgtgtatgtgtatgtgtctttcccccgtccatgtcatcagcagggagattaccttcgtggactcgctggggctgttgatgtcgtacaccatatcccgtattccgtcaatgactaccagccctacattttcggtgcggtaaatggcctccctcacgattgctattcgttcctcgggcgtgtacttccttaggacaaggaattcaaggtccttatggttcctgcctgtcggcagtcccgccatacgcaatattctttttgccactttcgcacagtggtaggaactttgttcggtatccacatagagtattttcctcctgttttcgggcagttccgccgtgtagcttagcactgtcccgtttttcagtgcagccgccacgattgcggaaacattgaacgttttcttgctctttgcttttccgattgatgcgctgaagtttcccagcgtgcctatgacggaaccgtgtattttcagtatttcgggtgccctctcgtagtcttccgaaaggtcgagccgtgaggcttgccacagtatcaccgccgcttcgggcgtgacttcttttctttctctgtactccatgtccgtacctcccttatctgcgtcccccgcttttgtgtcctgccagttcgagtgccatgtccgcatctacgatgattttgcgtcctatctgcgtaatggctctgtctatcttcccgcttttcttgatgcggtttgctgtgggcatactgcatccgaacaggcgtgctatgccgcctatcccgtacacgtatttcttttccgtatcggctgcgggctgtgctgctctcgcttccctttcctgcagggcgtgtcggttcagtaatatgaattcctctcccgtcatctgccatacgggctttgataaaagttctctgatttccatgttggaatgaatttaacgtttgtactgtaagccctgcgcacgggcttttttgtttcgttcgaacagtgcaaagttaatcccggatacgggtggtaaggatgtggatagcgtgaatggagtatcacgctatctcactaaatatcagaagataataaagagtggtgaaaaatatttcgggtggtaaaagtggttgtttcgtggaatgtcgtggagtatcgctgactatcggaatattgactgcatttccttcgcaaatatctgattgctgtcactgggaaaatcggaaacgggttctttgtattttgatttatagtatgtgtcgtctattcccagcaggttcatgatgtcttttctccatttttctctgtctggtttgtgcagtgtttcacccataaggaaaataagatagcatacacgagccttttccctcggtcttattatcagtttgccttcgcacggttgcaggttcatgctggcgtagaagtccagttcggaaatggcttcgaactgttcaccgttacatttttcgtaaacggctgacaagagtttcatgggaaaataggtgggtgagggtgtcggtgtggcggcctctttttcttccccttcctttttcttttggccggtcatgtatttttcgaggattgccagcagcgatccgtccagtctgtatatgtctccgcagcggtttttcaggtattgtagggcttcccgccttgcctgttccttctgtgcatatagttcatccagcttggctttctccctgtcgtattcccgtttgcactgcccgtatcttttttccagcctttcctcttcctgacgatcatgttccctgaaaccgactgcctccaaagagccgttagcttccataagttcccggtaatattcgtttgtgatttgcatttgtctttcgatgtcccggtcatgacatctttcatgctgccggcagatatgttcaatatcgagacggtcgaaaaactccttgcaggtattatacattgagatattgttttcaatctcccgtttcaggctgttcagcaatatggaaaagtgcgtaccctccgtttcaagcatgaggctgataagtgccttttcaaaggtctgtgtgtcttcatactctttgtaaaagtcatgaatgaacttctgcttctcaaaagagaggccgtcaccggatgttatttccgtatatgtcttgttgagtttcccgtagcggggtatcattgaggttattctttcttccatgctattgttgtgtttacagttggttgaatttgttcatcgcattggccttgatgtcatcggcaacgtctatgtatggtttcatcgccttgtagtcgctgtgtcccgtccacttcatcaccacttgtgcgggaatacccaatgccaaagcgttgcagatgaatgtccgtcttccggcatgggttcccagcagggcgtatttgggtgtgacggtgtctatacgttcatttcccttgtagtaagtttcccttaccgggtcgttgatttccgcaagttcccccagttctttcaaataatcgttcatcttttggttgctgatgaccggaagtgccttgtgatcttcaaagtgtacgcttttgtatttttccagtatcgccttgctgtggttgtttaactctatgataaggctgtccgctgtctttacggtggtcacttctatatggtcgggcttgatgtcgctccgtttgaggttgtacacgtccgaatagcgcagcccgctgaaacagcagaacagaaaaacgtcccttacccgttcgagatactgcttggtttggggtatcttgtagtctttcagtctgttcagttcctcccatgtgaggaatatcacttttttgggtgtgtttttcagcttgggcttgaagctgtcataagccatgttctgattgtaccctttcttgaaactccaccgcaggaaccatttcaggaaggctatctgcttgcctatggtgctgttacgcatatctttcttgttacgcaggaagtccacatagtcattcagaccgttctcggtgaacgtatcaaaggaaagttcatccctgaactctttcaggtggttctttaccgcagcgaatttttcgtaggttgcgtctgtccagtcgttctgtttcccgcattcccttacaaactcctcgaacgcctcccaaaagctgattttaggtccttcggctgtttcctgctctgtgactggtgcatccttcatccttgcattgaagctgtcctttatctgtgcgggtgtgggtagtacgttctgtacttcaaactctttgaagatgttctgtatctccgtatactgtcttagcaggtctgcattgatttcggatgcgcttagcttcagtttgtttgtgcatccgttctttaccctttgtttgtccgtatcccatttggtagcgtcaatgcggtagcccgttgtaaactctatacgctggcttgcgaatatcacacgcatacggataggcacattctctgtgattggcacaccgtttttcttccggctttccagtgcgaaaatgatgtttcttttgatattcataattgggtgtgtttgaaaattgacacccaaaaatacacccaaaaagtgagatatgcaaagatattaagagatattttattttctgtttactttgtaataacttggtaattaacaagatattacgagtttgtgatattgtttgaaatgataggtgatagaatctgtctctccgcaaacttatcggatggtaagtggataaaaagcctacaagttcacaacttgtaggctttttactatttatactttttatttccagaacatctgagtgaataaaaaggtataataatgctaccattttataatcagacattaccgtattgatggaaattatattattttgaccggtagaaaataagctatgagactcacagaccctaaatgcaaatacatttttgccttcattcttttattgggggtcttcttatgtgggtataattccaaacagtggtatgtcacaaatcatcggattaaaaaaaacatttctcttatttattcttgttcaaaagataaaatcgggcatggacgctttgaagaacttgtaaaacaagagtttaaagcgcagggtatagagcctgtgtttgatgaattttaccttgattgtgaccgtttcgaccagaaagtagaaatggaacatatgggtaattatcttgaaattctgaaaactaagccgatagatcttattttagcggtaggggaccaagctgctttttctttgttatcgacccgtcatcgccttctctattctattcctgtggtagcctgcaacgtgcatttccctgatgaaaatcttataaaagagtacgaatccagaaaggtatatgtgttgagagatactccggactttaaacgcaatatggattttataaagtctttgcaaccccatgtaaatatggagattgtttataatattgatttaactgctcttgggcataaatcttttgacttgctgaatcgggttatcgacagaaagaatgtgcagatttgggggcataagtcagcgttttctatggagtatgaatacaaggaaatgagagaaatgatagagtattacagtctgatgcctgctgtcgcaaatcataattcagaaaaggaggaactgactgtgagcctctgccctttccggtacataaaaggtgcttctttgcttgttatgatggaaaattcgaaatgtgagcaagagaggaaggcattcttacttgataaatttgatctggtatcgcttccgatagtaaatgctctgaatataccttctttcagttgtgtacgcgagggatttggagatgggagtaaaattgtaggtggttatatggctactgaagagatctctgcacaagctgttaccggtttatccgtccggctaatgaataaagagaaaataggtatgcctaagataagggatctggagaaagagtatgtgctggattggagtgtcttttcgtcctataatggttatgatattggaaatgtggcaaaggatgtgcgtattattaattatccgttctatgaccattaccgaagggaggtttatttattgggtgtgctatttattcttgcattcattttcatatcaatcagcctgttgcgtacgcggcgacgttctctgatagaacgtaagaacttacaaatattggaagaagcacacaaacggttgactctttctgccgacggagggcagatttcattatggaatatgcagggagatgacattgagtttgacgataattatacgcgtctgacaggtatgggaaaaaggagggttaagagaagcacctttttagagtatgtacatcccgatgattctcagttattgagttctttttacggagcactttacaaatctccgggcatgcaaatacaacgggcacgtttttgttttgatgaaacggaagaatatcaatggtacgaattgcgctgccggagtctgaaagatgtagaaggcgagatgatgctggcaggtatcatgcagaatattcaggaggcggtagaacgtgagcatcagttgattctggctaaacaaatggctgagaaagctgaattgaaacaatctttccttaataatatgagtcatgaaattcgtaccccgctcaatgcaattgtcggatttacgaatgtgttgataggcgaaggttccgaagagatagatccggatgaaaaggcaagtatgcttgatatcatcaatcataataatgaattgcttttgaagcttattaatgatgtgctggaaatatcccgtctggactccggaagtctggatttcgaaataaaggaatggaatatgacagagattatgaaagagatttatctgacgtatcagccgttaattcagccttccttgcagtttcatcttgaattgggtaatccggttcctttacttgtgcatattgatcgtttccgttttactcaggttatctccaactttttgaataatgcaaataagtttactcaaaatggtcatataatattgggatgcaaagtggacgaagaacatcatgaagtttgtatatatgtaaaagataccggtaagggaatcgatgaaaaggaacttatgatgatttttgaccgtttttataaaacagacgaatttgaacagggaagcggtctcggacttgctatttctaaagttattatcgagcgattgtcagggcgtatagaagtgcattcagagaaggggaaaggcagctgttttgcagtgattttatcattggcggatgtacggaaggatcatttggatgagcttttataaagtgtcgtggtgggtgatccgcttgatctgattcagcggggccggtttcatgatagtgtgccccctgtacttacataaaaatccccctctgtcctttgaggcagagagggatttcaacttattattttctcaatgtttatttacggaaaggcggttttactaccacagctttcagcttacggccacgcatatcgatgcatatctccgtaccgaccttgctatattcaggctttacatatcccatgccaataccgattttacgggttggagacattgtgcctgaagtcacaatcccgatcttatcaccttcggctgttaccagttcgtaaccatgtcggggaataccacggtcgatcatttcaaaacctatcagtttgcggactgtgccctcagccttctgtttttcaagcattgagcgatttgtaaagttcttgccatccacgaatttagtaatccaaccaagtccggcttcaataggagaggtagtgtcatccagatcattgccatacaggcagaatcccatttcaagtcgaagtgtgtcacgtgcgccaagtcctatcggcttaatgccaaactcggctcctgcttcgaaaacggcattccagatctttatggcagcatcaggatagaaataaagttcaaatccaccggctccggtatatcccgtgttagaaataatcacatttttctcaccggcaaactcaccaaccttaaatgtataataaggaatatcggaaaggttaatgtctgtcaacttttgcagagcttgaatagctttcggaccttgtacggcgagttgcgccatattatcagaagaattttccagttcggctccttctgtattgtgagagacgcaccaattccagtctttctctatgtttgaagcgttgacaaccaataaatacttttccggttcatattgatagaccagcaggtcatcaacaataccgccgtcttcattcggaaaacaggtatattgaattttgcccggcactaaagctgccacgttatttgaggtcactttctgcaaaaaagccaatgcatgaggccctttcacccaaaattcacccatgtgggagacatcgaaaacaccgacactattacagacagtaaggtgttcgtcaatgataccggtgtattcaataggcatgttatatcctgcaaactcgtgcatcttagcaccaagtgcgatatgtttctcggtaaatggagtggttttcatgaaatgagaatttaagaattatataaataatgattatttagaagctacaagttcagcaatcttcacaatgactttcattgccttttccatgttctggatcggaacaaattcatagcggccatggaagttcagcccacctgcaaagatgttaggacagggtaaacctttgaatgacaattgggctccatccgttcctccacgaattggtttcacattcggcttcacgcctacagcctccattgcggcaaaagcagtatcgataatatgcatcacaggctcaatcttttctcgcatattatagtattggtcacgcaactcaagagtggcggtacctttaccaaactctgcgttgatcttgtttaccagatgctctatttctttcttgcgatcttcaaatttattgcgatcatggtcacgaatgatataggatacagtactctgctctacatccccctggataccgataagatgatagaatccttcgtatccggaagtatgttccggagtttcatgccggggaagcatggtgatgaattgattggctatgcggatagagttaatcattttatgtttcgcatatcccggatgtacattacgtcccttaaaaatgattttggcagcagcggcattaaagttttcaaactccaattccccgacttctcctccatccatcgtataagcccattcacatccgaatttctgaacatcaaacttatgggcaccttcacctatttcttcatccggattgaaaccgatccggattttgccatgtttaatttcgggatgttcttgcagatagacaacggctgatacaatctcggcaatacctgctttgtcgtctgctcctaataaggttttaccattggtgacaatcagatcttctcctttgtgatcaagcaattcgggaaattgagccggtgaaagcacaatgttttcttcggcacagagtacaatatccgaaccatcatatttttctacaatgcgtggagttacattttttccactcatgtcgggactcgtatccatatgtgctatgaaaccgataacaggtaattccttgtctgtattggccggcaatgttgcaaaaagataaccgttttcatccaatgttatatcttctaaccccaaagactctaattcggactttagatattcggcaaataccatctgtcccggagtactgggagtaagtcttgtcagttcgtccgactgtgtgtcaaagcttacatactttaaaaaacgttctactaaattcatatcattaagaattaataatttgctaatctattatttttcacgcctgtaaaggtaaaaaaagagccgtgaactgccaagcaattcacggctcttttttaatacattattctatatttaatcactaatagctacttagaaacagctggagccatcgaaacaatgggtgcagaccttacattttggcagtccgatagcttcaattagtgtttcaatcgtattgaatttgagggaagaaagtccaaaacgctcagcaataatacttaccattttttcatattccggtgaaccggtagtagcatatttatccaggtttttgttttcatctccttccaagtcctttattatttgtctggtgatcagttccatatctgattttgaagcagtaaacccaataaagggacagccataaatcagcggtggacatccaatacgcatatgtacttcttttgcaccataatcaaaaagtattttcacattatcgcgcaactgcgtaccgcgtacaatggagtcgtcacaaaagatgatacgcttgtcctgaagcattgcacggttaggtattaatttcatctttgccaccagagaacgtaattcctgcttactcggagtaaaactacgaggccaggtgggagtatatttagtaatggctctatgataaggaatccctttcccttctgcataacctaacgcctgtccaatacccgaatccgggattccacaaacgcaatcggcgtcaaaattatcctgttctcccattttcattccgctcgtgaaacgcacttcctctacattacggccttcatagcatgaattgggaaagccgtaatatacccaaaggaatgaacaaatctgcattttatcgttgggcttacggagttgttctaaacggtcggcgtgcatacggacaatctcaccgggacctaaataacgttctatttcaaaatcaagattcggaaaactgttggattcactggtaacagcataagccccctcttttttaccgataattataggagtacgtccccatttgtcacgtgcggcaatcactccatcttctgttaacagaagcatggaacacgatcccttgatatggttatatacgttttcaatcccttcaacgaagtttcttccttgaataatcaataaagcaataagttcagtctgattggtgttacccgaactaagttcggcgaaatgcatgttttgtgagagtagttcctcttcaagttctttgaggttggtgatctttgcgactgtaacaatggcgaatctgccaagatgtgaattgataataatgggttgtgcgtctgtatcactgataatgcctataccggcatttcctttaaatttatcaagttcctcctcaaacttagtccggaaatatgaactttgtaaattgtggatcgaacggataaatccttgttcttcactatatgtcgccagtcctccccgttttgttcccaggtgtgagttatagtctgtgccgtagaataaatcggtcacacagctcgttttcgagactgttccgaaaaaacctcccatatgattcttttttgatgttgtttttaaaaagatggcgcaaaagtacaaaaaagattcgtgttggcataggtttctataagaaatcagtttttcaggcgatcctccagaaacgcctgtaaaatacgggcatgattataaaccggttccttagaagcatataaaagagtgactgttttataaggatgtatccggactaaaaaatcagctactttatcggaggtttcaagctctttccggtacattgccgcaaattcttcccaatgtcctgggatatctccgtgaaaccattttctcaaatcggaagagggagtcagttccttcgcccaataatcatactttaaatattcttttttcattccacgaggccaaagccggtcaaccagtacacgatagccatcctgttccgaaggatcttcatatacacgtttaattcttatctgattcatatcaatgatcttttgattataataacttaatagaaatagaaaaagtttatggaagaaaggacaaatcataataccttaagaaaatgtgagttttaaaatataaacattgtaagtgcatcgttcttcaagtggagattgataagagaagttatgaaagatgaaaatcggaacataaggaattaacaaaccattcattttgtttgtagagcttcatattggtattatacctatttaattattataatctgctgagaaacaattttatgtgaatagctctgcaaagcgatctaaacgctctttttctattccaattataaatacctattttacaaaggtttgcatttaattcaaaatttacttcccagaaataggcttgcggaaatttgcaagctacaaaaataaattatatttttgcggctgtttttgcaaaaccggtttacatgaatcggatcgataaaacaattattggcgaataattaactattaatgtttaaccaaaccaatttaaaatttagaaaaaatgaagaaaagtattattatgtttgcattagcagcattgatgagcacaagcgttttcgctcaaaacaatgatgcagaacgccttccggggtacaaaacaactttcgaaggtaatggattttggaataattggtatatgtctttaaactttggtgcgcagtctctcttcgctgaaaactctaaagatgcaaaattcagaaacactataacttttatgccgactctttcggtaggtaaatggttcaacccttattggggagttcgtttgcagggtacaggtggctcattgcatggatttacatctggagctaattcaatgttacattatcaatatggtgccgttcatgcagactttatgtttggactgatcaatttcttcgctccttataaagaaaatcgtcgttttgacatcgttccttttgcaggtatcggtggagcattcatccgcaaaggtgaccagtcatttacaatcaatgcaggtattcaggcacgctaccgtatttcaaagcgtttcgatatcaatgttgaataccagggagctattttagacgacgatatggtagttcgcggcggtttcccgaacgatggaatcagtgggctgacagccggcgttactttccgtttcggaaaaaccggtttcaagaaaggttactcttcacgtcagtacaatgcaattaagagcaactattctgacttagaggcaaactatacttctttgaaaaaagaaaatgctgcacaacaagccgaaatagctgagttgaaagcacgtaagccggaggttgtcaaagaagaaaccgtaatcgataattcagaaatcaaggccctcccaagtactatcactttcccgttcaacagcagtaaaattgaactctcacaggaagtaagtatcttcaatattgctgaattcttaaaagcaaatcctgaaatccgtgttcgtctgactggttacgccgacaaacgtggttcggaacaagctaacagaattgtttctgaaagacgtgccaatgcagtgacagaggtatttgtcaataagtacggaattgctaaagatcgtatcactacagaattcaaaggtaccagcactaaatttgaaaatgatgactggaaccgtgcagtagttgtggaattgattaagtaataacaattatactaccttttttaagaaggcgcattgatagatcatatcaatgcgcttttatttttaatggccttttttcagctctgccgcacattccgcgcaacatccttttaatacataatttatgcttcgtacggcaaatccttcaggcaaatctactacggggacatgaatgttttcaaggcagaaagtcttatggcaatattcacagtaaaagtgcgtatgcaaatctttcacggcacaagtacattcactgtcacaaaccgcatattttaaagatcctgtaccatcatctacgctatgtgccagatgttgggaaacaaacagggtaatcgttcggaatatgctcgacttatccacagtatccagtttgttctccaaatcaagaagtgaaacagcttgttccgcatctatcatagcttttaaaaccagcatccttatggcagtaggttttattcctctctgttctaatatcttcaaacacaaattttccattctcatttaatcattttctgtatacgaatagcattcactatggcaatcaatgtcacacctacgtctgcgaaaactgcttcccataaagtcgcaataccacttgctcccaataccattaccagcaattttactccaaatgccagcgatacattctgccagatgatgcggcgcgtacaacgtccgacctttatggcagtcgccactttcgaaggttgatctgtctggataaccacgtctgcggtttcaatagcggcatcacttcctaaccctcccatcgcaatacctacatcacttaaggcaagtactggagcatcattcattccgtcaccgacaaaagcaatccggttatctttgttttccttcagcttttccatatgctctacctttccttccggtagcagatcaccatacgcccgggtaagtcccagtttgtttgcaaaaatgctaacaatactctgtttatcacctgacaagatctgaatattcttaatatttaactctttaagtgatctgacagtatctgctgcatcgtcctttaacacatcggacaatgtaatgtaacctatatatttatttccgacagcacatacgactgttgtttccgttatcgaaagaatatacgccggaaactcaatggaatatttcgacaacaatctggcgttaccgaccaacactttttctccgtcaacctcagtcattaacccataacctgcaacctcttctatattctcagcagcagtaaggccaatctttttcttttcggcataactaacaatagctttggctatcggatgagtactatttttctcaacggaagctattatacgtatcagttcttcttttgaaacgcctggaataacttcacaggattccacttcaaaaactcctttagtcagagtacctgttttatcaaatacgactgtattgacacgggttatggcatccagataatttccacctttgaacaaaatacctaaacgggaggctgctccgattcctccgaaatatcctaatggaatactgataaccaatgcacacggacatgaaatcaccagaaaaaccaatgccttatacagccaatcattaaaaacaaatccgaataacgggtttatgaatgaatagatatatgggatcagcacaatcaaaaaggcaaggccgataacaataggggtatatatacgggcgaattttctaataaacaattcggccggtgctttacgttcagaagcgtcctctacaagttccagaatacgagccaatgcgcttttatcaaaaggctttgtcaccttcatccggatcactttgtctgtaacaatcataccggcaagtacctcctcacccttgcgaatatctcgtggaacactctctccggtaagggccgctgtgttgaatgctgctatttcgttaagcataattccatccaacggtacacgttcaccggcttttatttcgataatttcgtttataaagactgacttcggattgattgtaacgatctcgttccctctcactaccattgccttttcgggtctgacatccaacaaggcactgatattacgtttagccttgtctattgctcgatcctgaaataattcaccaactgaatagaacagcatgacagcaactccttccggatattccccgatataaaaagcgcctaatgttgcgactgacatcaacgtaaactcactgaagtaatctttctggagaatactttcccatgcttcctttatcacaggtaagccgacaggcagataggccaatacataccaaaccaaagaaactgtattttccttgaaaaaagcaatatccagttgattcattataccgcctgctaccaacatcaccaatgaaagcattactttccaatattcgcctatgaagccatttgcttcctggcaatttctgacccgcatatttgcattcgtttcacatttgcattgtcccataatcatgtttattattaggtttatgatgcaaaggtagcggattgcaggtgcaacaaagttgcaaaaactcaaccgaaaaagtttcgaaggcatttcggaatccgggaaggtactttttacatcaaaacaggtgcaaggaatttaaccagaaaatatcccccggcaattagccatagatacaacagggaagcaagtataaatggtttggcaccagcttttttgaatttgtcaatgctggtttcggctcccaatgcagtcatcgccatggtaagcaaaaaagtatccagattattgatgaaagtgatcaacccttgtggcagtaaatcaaaagaattaaaaccgataactgccagaaaaccgatggcaaaccatggaatggatatgtctttcatgcggccgccttgtccgcctgttttcactgctgccctggataccatgaaactggtgatcaacagtaccggaaccagcatcattacgcggatcattttcacgataatggcaacatcggaaatttcttttcccatcgcatttcccgcacctaccgtatgtgcaacttcgtgtaacgtagcaccggtaaagattcccatttcgttgggcgacaacataaaagttccgtttctatataatataggatagataaacattgacagagtaccaaaaataactacggtggacacagctaccgcagttttgtatggcttggtctggatggtcgattcagcccctaaaatagcggctgcaccacaaatgccgctaccaatggaagtcagtagtgcgaccccacggtccatcttaagcatacgtccaattaagatacctccgagaatagttgtagctactacaatggcatcgataaatatggcaggtagccccactgccagcacatcctgaaaagtcaatttaaaaccataaagaataatgcctatccgtaagatacgttttgagcagaactgaatacccggtacccatgtttccggaagattgtttctgaggctattggcatatagcatacctaaaataatacctacgatcatcggactgaaagagagtctttttatgaactccatgtcgcctatgtaaaaggctgcacatgaaaacagggctattaacaagaccccgtgaagcatactgtttcttttttcgcttaacataaatgaatttatttatagtgtttttattagtacaccacaaagtaagcactttaaatcgggacgcaagcaattaaaaaatttataccccataacttatcgttatttctgttcttgaaaatatgttccggttttgttattataaaaaagccccatccaaagtataatctatacgcttgggatggagcttgatttcaggaaaagtcagtcagactgatcactatccttttatttttctgcaggcattgccggtgttgtgggccaatatggattttggtacagcggagataaatggacggatgtatggtcagaagctgtcaacaggaattgtttaattggcaatggttgtaaataatgggccatatgccagatataaccatccttatataagttcccggatcccatatttttctgataaggccggagatactcacttaaactggcgtttgagacatttgccgatgaactaccgtcagcaaccaactgaccggcatcataccattgttccatcggagtgttccaaagatggattccctccacatgatacggttccaccatcatctgctccaatgctctccaccgtattagatccatccagcgtaatccttcagccattaattcactgcgacgctcccgacgcatgttatacaaaacagggtcagtcaataatgatccggcagagtatgcgccccaatctaacttctctttttccatattggtggatgcgatagtcacttgagggtcaatagcggttccattgaagccggctgctgtacgaacggttttccaatactccaatatctttcctgaagctatattcttcgtcaactgatactcagcttccatatagttcaaaaaagcttctgttgcacgaaatactattgatccggtatagccggttccgttaccacacagctttttatcgaatgtaccacctttgcgaattgcatatcctgtactatagcctttttcttcgtttgtcgataatatgaccggatagggttcatactccattcccatttcctcttcagcatccatattcttaaataaatttttctggttcggttctttcaggaatatgtgtaaacggggatctgtattttctctgactgatgccaaggttttgtcatcataagaaaaatcatcatgggatgcataaacaggcttgccgtccttcatgacaaagccttctaccatactgcgggttaaaccggtaccatagttgccatgttgaaccgaaacctcgatgttattcacaatactcagtcctttgctgtattcacgccaaagcaaaacgtcagggtatccggacatgtcgatattgccaaacatgctgaaataaggattgtcaggatccgtttccgattgaggcaccattcctgtattttgagttaattgtcctttgtacttatcagcaacagtttctgcactttttgctgcaactgtaaagaagtaggttatttcattatcgatattacccgaaggatattcgtagttggcattatactctttatctttaccgggccaaccttcaccgttcggtacaaaggcagttcctttaaaatagtgcaaccatgagccctcaaacaatcctacacgcgattttaataaaagagctacatccggagacaggcgattgcgacggtcatcaaaattgtcgctcatataaattagtgcactgtctaaatctgcaagaatgaaacgggccacttcattgcgtgggctacgtttgttggcctctaccaggattgtttcatcatccggcatagcttctttcaagattggtaaatctccccacttttgaagcatatcaaaatatgcgtaagcgcggaaaaagtaaatctcgccaatatattgacgaatattgcgctctgagccggaaattcctccttgattataataacctaatattgtattcaaggaataattgatattgcggatattgctccatgaccagttgccgttggtttgcccaaccttccactgatctgttgcatatctgccgtctgcggaaaaagttgcctgattgtctgtgtgaacatcgtaggcaaaagttccataattcccgccatgagagggcaatacatctgtatatagtttattggctatggcctgaacctggctttctgtttgataataatcttccggaactacataagaaggaggttgcttatctaaaaaatcttcacaggcaacaaccgaggtagcaagtaatgctacagatacaaaacgtagaatatttaatttcattgttatcttccattaaaatgttacacttaatccacatgacagagttctcgacaacggataaccgttacctcccgaaccaccggagattgtttccggatcaaattgatcgaccaagcttgtcccggtccacaaattttctccggagaagtatatacgtaaattctggactccataacgagaagtcagtctggtagggaatgtatatcccaactgtaagtttttcagacgaatataagcagcgctctgtaaatagcgggtctgtgtctgtagattcttattgctatatagtgggcgaggtaaataggaattaagattaggactctgatagccctcctgaaccgaccatgtatcatcattacggaagtaatcacttacactttcaattccggtagcatgccacattccgctattgcttgcaccaaacagataagtacttccttgccagaagtcgcgtttcataaccccttggaagaacatacggagatcaaagcctttccaggaagcattcagatcaagaccaaacagataacggggagttgtattacctataacagtccagtcccccgtatcattcagtgtccccgaaccaccggaaatcttaccatcaccgtttatatctgcatacataatatctcctgccttccagtccgaacccaatgcgctctgtccaccgttaggcattgttgctaaatgggcctgcatttcttcatctgtctttgcaagtcccactgtagtatatccccatatctcattggtatagcgtccttcaatatacgtactgactgctttagtcggattattcggatatcgtgtgattttcgtacgggcatccgagacgttaaatttcgcgccatacgtaaaaccattattcaagcggtcattccaaccgattgaaagttcccatccggaggttctcaagtctgtattgttggtaatcggtacacctgtacccagcagagccggtagttcgggagcgttgccaaccatattttttgtatcgcggatataccagtcgaatgatccggtcaaacgattattgaatactccccaatccaatcctaaattataactctcaattgtctcccaggttaatgaagccgaaacaagttccggagccgaagcggtattgggtttattgccactcatcagccatgcgccattcgaagaacccaccgacatggtttgataagtctgataccagttcgttgtattttggtttcccaataaaccgtaggaagcacgaaacttaagaatattgacaatattgttcaaaggttcaaagaagtgttcacgcgcaacattccatcccaaagagaaagaaggaaaggttttccactggttgcctttgcggaaacgtgatgtgccatctgcacggagatttgcttcgagcagatactttccgtcataactataattgatacgtccgaaaaatccggctgtagcccagtcattgcgggatccattgacagatggggttatgggattcccgtcgtaatcgagcccgttagtcaagtctacctgaggtttattcggaaacataataccgtcacgttgcagaccgaattgagtttgtttcagattttcagcctggaagccacccattacatgaagatcatgcttttggttgaattggtgtgtgtattcggtatatatattgaaattataataattctctttataataatcttcgtgtacattcgaatatttgtcgcaagcataggcattgccttccacatcatggttgtaaagcacttgtttatcccagtagttattggccgacttgatacggtaattgaaatccacgtgtgtaatccagtcttttaccggttcgaaagtaaaactcacttgatgatacatgttatccgtttgaatcttaccggttcctccttccgctaatcccaatatgggagaaggggcataaaaatagtaaccgttgggatcatacaaaggtaaaacaggccaaccttgacgagccatgtccgaatatagagagttagtcattgttgtggggcgtttgtaatcttcccgggtaaatcgcattgtatagtcaaacttgagccatttagtcagttcggaaccaatctttgcagtgccattgtagcgagataatccctcttctcccagattcataaaaccaccttggtccagataattgaatgaagcataataattcaacttcttagtgcctccattgacactaaagttatgttcttgtgagaaggtccactttttaaaaatcatatcataataatcaatatcatctaccccggtcacatagccatcttgccagtatccgttatcaccggccaagagggagtacaagatagtcccatcgtcagtgatacgttgtgcaggtccgtaaggtttggcattgtgataggcaacaatctttttcatacgatcatttgtaatgtaggttccacctcctccattggtattggtgtcattgatccaactggcaaagtcaaccgaattcatcatatggttcatattaatcgggtttccccagcggaaactattattatagtttacctgggttttgccttccgtgcttcctgatttggttgtgatcaagattacaccgaatggtgcacgtgaaccatatattgatgatgcagccgcatccttcaaaacagaaatattggcaatgtcctgaggattaatggaattaagatcaccttccattccatcaactaaaaccaaaggttcaccgctggttccctgtccgatagtggtagtaccgcgaacatttacacttggtttatcttccaggctaccgttcgtctgtgtgattcgtagtcccggaaccataccttgcaatgcttgtgccgcattggtcaccggacgttctttcaactctttggctgaaacaacgctgacggaccctgtcaggtttacctttttctgggtaccgaatcccacaaccacgacttcatccaaaacctccgaatcttctttcaaagtaatattatacgattttcccggagacgtttttatttcctgagacttatagccgatatatgaaattacgactatcacaccatccgggacagacagagaaaagtccccctctaaatttgtcacgactccattagtggttcccttttctacgacgctggctccaataaccggctctccattggcgtccgtcactttgccggaaattgtatttttccgctgaaaagtctcttttactacaacattaggcttgcccgatgttgcaaagacagccgagggagcaaacccggcagacagcaataaagccaatagtaacttacaattgtttttcactttcatgtttttcatgtttttaattttccaatcacataaaattaacgttaactaaataaatgtcattaaattaagtatatcaagtttggccaaaaatgattatatctccgaatctaacgcagttcctttcttctatacgggttatttcgaattcctatcgaacatgtcttttatttcctcaaagttttcaatgattgtaggatcgaaatctgtgctattcatgtatttcagtaatgaaacaagcatttgttttgctaccggtctgttctctaaatcagattgcaaatcgaaagtggctaataccaatttgcctccatgcactttgccttcatacaaagaagccagacggcgattattagtaaagttatcgaccatttctacaataggggtccctccctgtatactatctgttatcatggttttggagttcttatttaaatcccaccattgccaatcggtgtgcatgtctgtcggaaaatcagccaatgctttatgagccggattacataatactcccattgtcccggcctgattcggaaaatgtaccgggctccagaatacaggtacgaatttgccttcgatacctttcatctttttccaatccggattgaaaaggactttttgcccttcattcagccatgccatggcctgatcataattacgggtatatttcacattaccccattctactttttctccttcaggataaacccatatgttccatctgtttacataatctgttccgattacttttacacacacttccagttttgaagcattctgtatgtctgtcaagggtaccgatatctcacccaattttccattataaccaaatttcaattctcctacttgtatttcaccatgctttacagaacgtcctttatccagaatatcccaatgcagtgttttgtttgtcagaatatcgtttccgtaattgcataactcgatcttagcttgaaacatttcatcgtttttatatactgctttaggaaagcgcaataacggcaccaccggtgaacaaaactcccggaaggctttaccgtcgataattcctttactttcccagaaggcattcaatagtccgacgagtgctgttccttgtcccggaaagtcatgtaaatcaagtaattgaaaaccactgattccatcagttttcaatgcacgctcaatttcttctttatataagattgcggctaactttccggaagccattaaataatcgggtgctttatcaagtaatttctttttttcaagatcattcttcacagccataaaatttaagggtttcagaactccggtatatttggaaatctcggttaaatccggataaaccgaatattggcctatttcgtgcgtaatcagagggacctgtatacctgcaaccgactcactgtaatctttatcgaatgtaggggatagttgattgaaaactccctgtccccgtacccagcctttattggtccactgcgtgacaaagaaatcatcgtttgattccggccatccgccatgtccgccttcgaacgtaaacgaagttgttacgtataagtgtctgttatcctttgctttcaattcgtctaacattacagacagaatggtgaaatctccctgcaattcgtttcccaggctccaaaggcaaaaagaggggtgattgccgtaatttttgataatccggtctgcttcttctcttaaaaagcgtacggcacttgaatcctgcccaattgtaagtacccatgcaggaagttcaacctgtaaataaaatcccatttcatctgctgcttcaaaagctgcttcgggagggcaccaggaatgaaaacggagatgattcagcccatattctttggctgcggcatatactttttgccagccttctttattcattggaggagttccggttaatgggaatatgcaacactccaatgtacctcttaagaacaaaggtttattgttcatcaacattttatcaccgtttgtttccaattggcgcataccgaaatcttcttttatttctgatactcttccattggcctccaatgtgaccgtagcctgatacatttcaggagtaaattcattccataatatcgggttatctcccatgttgtaaagcaactcaaccgatgaggctccggctttcacatccatcttttttacctgctcttcaagttgttgagagccgtttcttgcagatactttcatcgaaagcaatgcatgttctgcggcaggtgtattgtttgaaaacgaaataacggcttttacctgtttgttttttacatcgggatatagttgtacgctttctaaacgtattttttccatggcccggacagtcatatctcctaaaataccattccatttaatttgtgtatgatctgtatatgcatgtgccataccattggagatatcataacgcttgcgattatcgacgcgtatggtcagaatatgctttttaccgcatgtcatataaggagtcagattgtagcggtgtggcgtgcttaagctttcttcatgtccttcgactttcttattatctacccaaacctgagtatcccacaaggctcgttccaaatccagaaacagctctttatcattccattgggcagggaccgagatctctcttgagtaccatgcaactcctacgtaattgtgcaaacgtgtgagatataataactggggttttgacagtgcaggttccaaggcattgggggttccaagtccggcatcgtcagttgtacccggtaactgcatggacgtttcaaacaggttgccttgccatgattcttttattccaacatctgtactgtccagcctgacagtccactctccggaaatatccaactgtttcttttcagaagaacatgatgtcgacagaataatgatcaataaagaaaatagtagttttttcatattattacattttaaatattacaaatagctgatctttcaacattgcaaaatagctaagaaaatataaccttgaaaatgtaagaaaggactgttatgatgtataaaatctctaattttaagtgattatatcattgattatctttagaaataccctaataaccagtgtttttagattaattcaataaaaagagtcgaaaaatatctcgttttataataaagatgtatatttgcaaaaagagtgtaactatggaacgcaaaaaagaaggatttaccaatcaaagagcgattgttcttcctgaagctataaaaaaaatattggtcggcaacgagctgactaatttgttgtatgtaacggatatcgggtattatccacatgccaccggacactatcgagccagaagatatggttcgcaacagcacattcttatatattgcactgagggagagggctggtatagcattcacggtcaaagacagaaagtatgcaaagaccaattcttcattatcgaagcgggcttgccacacatttacgccgcttcagaaaacagtccatggagtatatattggttgcatttcaccggagaaaaaagtcatttgtttaattcattctacaacaaactgcataaaatagatgaatctcccaacgcacgtattaaagatcggatgcagttgttcgaagaaatttaccagaatctggaaatgggatatagtattgaaaacctggaatacactacactgtgtctatggcattttatagcttccttcaagtttgtttcacagtttagagaaattaatcgggccaaacaaggagatgtcactcaggaagcgatcagttatatgagaaagaatatcgaaaagaaactctcgctggatgatatagccggcagtgtcaactactcatcttcgcatttcggacaagtgtttttaaagaagtccggatacactcctttaaattacttcaatcaattgaaaatacaaaaggcctgtcagttacttgacttttcagacttgaaaataaaagaaatagcagaacaacttggcttttatgatcaataccatttctctaaagtattctataagcagataggcgagacaccaagcagttacaaaaaaaggaataaaggataaaaaagaaaatgcaaaagtacaaccgataaatatatgaaagtagtacttaaagtttgtttataaagcaaattgagtgtatcttagcaggcaagatgtatatcttagcggccaagatgcaaatcttagctgctaagatgcacatcttgcgacgcaagatgaacttatcgcctaaggggaggtcatttactgaagtagccggagcgactttgtccggcatacttggcaagtttttacctttacttccgacaagcccactctttatcggttttctctattcaccttttaaaaacattgcgagctatggctgaatatcaaatgcaagaactgactcttcccaatgaggaagacaagaaaatccttttcccgcgcatgaagctgtccgggcaggtagacttaaattacattgcttcacacattaattatgcaagttcttttaccccgggagatattattgggctgacgaaggctttggcgcaagccattgcctatgaaatggggcagggacattcagtgaaaatcgacggactgggtatctttactccttcactggggttacgtgacggaaccgagcgtgagagcggtgagaaaggtggtaaaaaacgtaatgctatgagcatctgtgtaaagaatatcaattttcgtgctgacaaacaactgatcattgaaacaggagaccactgtatgctggagcgttcggaatggaagttcaggcactcttcgcaattctactcagagcaggaacggctcaagatggcacaagactatctggccgtgaatcattttatgaaagtggcggattattgccgcttaacgggattgttgcgtgacaaggccgcgcaggagttgaaacgctgggctaaacaacccgaaacaggtattgattatcggggacagggctcgcataagatatacgtggttcgtctcaatccatgagcgtgtccttacaaaaaggataatcagtgtatacgcatcgcgttgccgggatatactgctgtttttctaaaaaaacaaattccggtcacgactatcagtctggctggcggtcgggacttagtggtagcgatacttagaagataaataaatttccacgaaaggtggaacttcagacttgctttttcttcactaagaagtatccactctcgaattaaattttaatagaactctaaggtttctctaacttcctctatatggggaagcgagtacctttgtaccaacttttatatagtatagtaggaatatctttaaatgatgaaagaatatacttccgcacttatctcacttgaaaaggcatgtggaatattcacctttgacttaaaatctaaacataaaaaagaggttgcactaaaaatcttttttatcttaatgtaacctctttcctttttaaacgaatgcatttgatctcgacctgcaagtataacctctatggtatgtacttctattaagtacctcttttatttggaaacaatactaaatttattactttgtaggatttgcgaatccttttggtcttttttggaatataaattaaaggccattggcttatatttgctgcatgataaggatgaataaaattcatatctaaggattaacatcaaacctatagctataaggtaccatttttataatctattttaaatgaaatcaattatgagaaaacagaataatttatcgattttttagtaataactatgctgaagttttcatagaaaacgacaggatgaatggttatagcagggacgaagatatcgtgatggtagagggagcatacaagacgccacaatgtgtggtcagatcaagcttaacaccaagagcctgcttagatattaaaagagaaataatcattaaaattgaaatgttatgaataaaagaataatcgtcaattttcttttgggagttgtgctcgtgtcttcgtgcactaatgaacaatttacggaccctccttctatggtctcacaggcggaaactcctgatattgttttaaatgtgaatgaagcagtggaagattttgatagcttcgtttctaagctacgttctgctggaacaatcaaactggtgactcctgattttacacgtattgttaagaacaatggagctgacagctgttttcaggcggaggggagcgaacgattgctgctaagcaatgattctatttctatgattttaacagatcagtacattgtttttactagtgatctgataacagaacaaaattataaagcaacaacaactcaatattacttagtacacaagtccaaagagtatgttgcagaatataataagatattgaccagcgaagtgaatcagctcgtaaaaacacgtggtttagatgaagattctcccaaagtggtccttcattcgaacaatgcaatatcaataaatcaggctctgcacttgtccgagactattcttgaacagcctcaaatgaaaaatgaagttccgttttcaggtttaagtggaatgcctgaaactaggagttcaagaatcggccaccgtcctaaagatgtactaagaatctggttaatccgtcataagggatattcgggatttcaacatgaagtaacctggcagcaaaatgatacccgtgctatgattaaggatcttaatccgaacgtcaaggtagagttctatactcgttatagtaactttactgccggttcagacgcttctaaaacacttgatgagtttagaaagtgggtgaaagatagtaaatcaaagggatatgactggtcagacaggattgataaggatatatttattcttatttcttacggaggatataatgaaaatatagtcggattaggagcattagacacctataagttggacagagaatcgaacccacgtgcatttggactgtccgctatgaaccctataaccgcacctaaaactttggcacatgaactaggtcatattcttggtgctgtccatacggattatacttggtgggaaggttggtggatattccagatcccgcaatatgatgtaatgtcgtatcgtgaattccgcagaaatttgatacgcgatcctaataatgtccgcatagtacgaaataacttaaagatttcacattagcctaatagaactgaccattgcgaaatagtccaattctgttatttttagtggattagaaaatagttgattagtagaaaattaacaatgaaggggctgtctaacaacaaaaagttagatggtctctttttctagtataaagactgcccaaacttattggatagtctcttaatgttatgtgttcttgtcatatgcaaccatcctgccaacatgaagggattataagggaataccagattgtgtattttagccatcaacatatattatatgtgaatcagtaggccaactactgatttgcataatttatatattctttctcaattatttcctgtggccctatattgatagtaattcttttttataaatacgcttcatataacctttgcgctcccttatgtgtatatttaaagtgccttcggttgtttacgaggcggatttagttttaatatataatgtaaaagatgcaggtttattgaattttataataaatgagacctgtttcaatttttgctcttgaagtagtcctttagcattctaagtggacgttagttgttagtaagcaggtcattctgtaattctgaaaattggagagggagaccacaatctccatatatcattggtttacgaatgtttgttgtaattcgatgtagtcatcgcctgacagagtatagtggagcagcagaccatatcgtttgatatggctactgttacactgcaatacaggtgagtttcatttctctgttggcaaaatgttcctcaatgatagtatcggcgaattccggaatggctttgataaggtttaagctgattgttggaaaactaccctgcagcgtgcggtatagggataaaatagatgcgttgtgtctgtattatatactttttatcaggatatgttccaacatatcctctgttttcagtgttggttgggcgtattcatttgacgctcttttccataatttgcaatttttcatattcaatggttgtgggtaaattgataaatacagaaattgttttttttaaataatgcaaatgtagtgacttgatctttatgttctttatgaaaaaatctgaaattattcattggccaaaattttcttagacaattgtttgaaagtagagaagaaaacgtctctcaacaggcgttggttacatcaagcatggaaaatacctctcccccctctccctcgtggtttgaaattatttcggattttttttaaataataataattgtaatgtgactatttttgccctcaaaatcttatagaataaaactttatacactgagaaaacattaaaatcactcaattatgcgtatgatagaaaaaataaaattgatactacttacttacatagtcttgttgtttgcttcatgtgcagttgaagaagaagttaaagaaaaaagagggattatgttcagtgctcaaacacgcaccaatagttccaccactgaatacacgaacttgcagcctggagagcgggttggaatgtatatcgtagggcgcacccagataggtacggagtcttcgctcaaacccacgggtaatactttcgacaatctcttcttatcttgtcaggaagaaggagctctcagacctcaaacagtgactcggtatcctccagaaatcagctatgtagacttttatgcttatgctccatatgatgcggcaacagaaattgcgtcaaatcagttaatgtcattcttcgtacagcacgatcaatctctctccgaagcagttaggaaatccgatttgctatggtcaaaactgctaaatgttgcgacaacctctacatcaattccttccttgacattcaatcactgtttgagtaaactgattattaatctgaaggctggggtaggagttacattaaaaaatacgatcgtgaagattaccggaaccaaacctggtgttaaattaaatatggttgatggagcactcgcccaagttcagggcgatgcgatagagataactccaatgatctatgacggcaagtcgggatataaggctatcattattccacagatcgttgctggagggaccagactttttagtatcgttaataatggaaaaaactattattatacaatgaaaagtttaaaagagttcactccgggaacaaagtatacatacgatatcactataaatgcggatgatttgaaggtagaaatgaccggtagtattaatgaatgggagcctggagaaacgacaaccgaagttttgcttgaaagtttatctataaagcaacttcctgataaaagagtctatgctttggaagaaaatatagacttaagtggactcaaagtgcttggtaactatgatgatggtaagcagcgtcctgtcaatgttggcatagaacatataagtggattctcttcttcaattcctgtcgaagagcagaatgtagtaataactatagaagataagcaggtctcttttcctgtccagattgcccctgtacgtgtagaaaatggtgtcttgtcagaagtcttaaatggttatgatgagatcgtgcttccgaatcatgtgacatcagtttctaagaaagcattttacgaaaaaaagattattaaagtagtgctcaatgaggggcttaaatcgatcggagaggatgccttttttgcttcaactgttcgagaagtgatctttccttccactttggagcatttggaagccgatgtcttttatcactgtcgcaacttaaagctgatagatctgagccacacaaaaatcactaaacttccaaccggtacttttgcatataccggagttgaaagagtgttattgcctgaagggctgaaagaaatcggatcacaagcatttattaatacttcccgactggaagtgattgaaatacctgagaatgtgaaaataatcgggcgtgaagcttttcgcgagagtggtattaaaactgctaaactacctaacggaattgcaattatagcgggagctgctttctatcattgtcctgaactgacagatgtaataacctatggacccgtttccgatgactatcctgatgctataatccaaacttattgctttgaagggtgtccaaaattaactcgtttcgaaattccgcaaagtatccggatattggagcaaggtttactgggtggaaataggaaagttggccaattaactattcctgctaatgtagtaaagatacatttttctgcatttggtgaaacgggtattaaagaagttaaagtaaaagcaataaatcctcctcaagcagtgttcgatgttatgtggtacggttttccgaatgatgttaccacaatttcggtttttgccggatcggtagaacgatataaaaccgagaaaggatggaaagactttgccagtaagataacgtcgctgtaatagattaaaattacttctatactattatgcttttttgtataaaatgaaacaactgaaatgcggtgttattactgctaagtgattatcataacaggtacgatttgttgcatcagactcttcaataggcacctaatttagagtgttacgtatgttttatatcaatgaaaatttgcatatggtttgaaatggaggtagataagtctcttaaatactcttcagatacgctttcttaattaatcaaattcgcgcaatctcattaaataggtttaaatgttaaagtttgtgttgaaaatgtgttgtaaaagaattatggacatattcaatgtgttgatctgtgggttatttttttacatatttaccaaactgcagaaagaaggaaagtttctataaattgatatccggctgaaagctgcccctcttttcaaatggtagtgggttatttatggctttagttttaaaataaattcaactgctaaactgaatattaaaggcaaaagaaaattatttattatccttttaaagtgatagaggagtgctctgaacagcaaaaagagtgttttcttttaagtccaatggaatgttaactaaaacaatgatacggagaataaacaaatggataaaagagaaaagataaaaagaactgaagttgccgctaagctatcacttaggatctactaccgataaaacaaaagtgaaataatcaaccatttataacataaatatcatgaataagaaaagaaaatcaaaaaaattattgtacgcagaggaacatttatcatgtgtcaactatgtaaattctcctcaaaccggattcaggtacgaagagatacctgccgggacttactttcaaaaagattcgatcacccagaattatatactcatgtttttggaggggagttgctccataggttcgggattttatccgcagagggtttttaaagcagaagagatggtgctcatacccaaatccagcgtatttgagggacgggcactggaaacgctaaaagtacttgtgttccactttcatgtgcccctgaacagttgtgatacggtgacatttgagatctattcaagatactgtctgagaatagagtatgatttttcacccctcccatttcgggagcccctgactcaatttgtgcagcagatgattcattatctgaaaagtggaataaagtgcgcgcatctgttcgaaattaaacataaggaattttttcttttgctgagggggttttatacaagagaacaggtaagctatctgttatatccgatacttggaaaagtactttcttttaaggactttatactatcgaattacgtaaaagctggcagtatcgaaaatttgatcagcatgtcccatctgagtaaaagttcattttatgacaagtttaaatcggattttggaatgacagccaaacagtggatgctgcaacaacaaatgaacattgtacgggcaaaagcctgtgaaccgcaggtaacaattaaggatcttatggatgtaataggatacagttcccctacgcacttcaaccgtttctgtaggacttacctggagtgtacacccggggagttgctgaaaatcagtagagagtaacacactgtaaaacatatttttacataatacttttaaataaaagcttctacttttgaatcattgtggagttttttgaaaagaagataagtcgcatctaccgtatctttgccccagataaaaaatgaatcaaaaacaaatcaaggatatgcaggtctctctattatctaatagaaagatattgttttctctttattgtttgcattgtgtcatttggtgtcagcagttcattatagagtaagtagttgcattttggctgctgatcatcttccggtattagagtctaattgtataaaaaatgaaataaatattagtgctttttgttgagattataatattttttatttcagaggtgctgataagtttttaattatttctatatatcatttattaatttaaaaatttgtattaacatgaagaagagttgtttttatgccggtgcgctggctgtattgtttgcttcctgctctaacgaggatggtctgactccgcaggtgggtccggggcagcccggaggcgatgtcgttaatgaactgaagatttcgctggtgtccggaacagggccgggtacaagaacagcgcccggggagggaactgaaaataccctgtacaatgcttttgtgtttgtaaaagccgatgtggacgggcctgatgccgcaagtcagacatatgattataaatacattgttgtagagctaacacaaggtcaaaccagtactgttgttaaacatgtagaaggtggttcaaaagtgtatgttcttgcgaatactgattacctcactaaagcaggtgcggaagggctcgctaatgatgttaacggcggcacggttaattttcacgattttgtagaagctattgacaagtcgtatgtttcaaagcttgaaacaacgactggaaggttcatcatgtctggtgttgcaacggttcctgcattgaacagcacaggagcaaccgttcttgcggtaagtttgaaaagagatttggccaaagtgaactttaaggtaaataaagcgtcaactgaggctaatcttaggattaaaacggttgaagagattactgttcgccgttctgcggatcatatacagccatttgcaatgaatggtacagcctcgactacctatgttttgccatacggctttggcgacgccaactatgttcaggatggtttgaaaggtgacgtgctcacaccggataatgatcatcagacagcaaatgcaacagacttctcatttatttatcgggacaaagacgtggtgacatctgcaaatgattttacttttagtaacttctatgttttgcccaatgctgcaagtactgctgaaaagagcactatcattgtcctgaaagctaaaatagaaaagcaaaaagcggacgatgccaatgtttgggaagaagtacagggctccaaatattataaagcgcgtatttcatccggcctgacagcttataatactgcgcaaaattccagctataccattactgctaccatcaaaggagaaggaaacgataagccttcgggccctgaccctgatagccctgatgccgaaaatactgagagtgatttgaatatcaacgttcaggttgagccttggagcctggttgttagtagtcaggaaatagagtaagttcatttttcggaataacaagtaataagtactgcggagtgatccgcagtattattttcccaataatattctttcctatggtattttccagaactatctttccgtatcttcttctgctttgtctttttctgcattcgtgtattaccgacaactacgaccgttgtctgggtattcgtcttgctttgagttatccttccgagggcgagcgctgtgagaggattcatatttttgtctttgacgagcgtggcagtctgttttcttcttacgagaaaacgggtcgacagcttgctccgggtgtcacctacctcctgcaagttcctccgggaaagtatacggtcgtagcctggggagacgtacacggagattactcttttacccgcaaagacattacgcgggcttccacggggcagatgatacccggttccgagctggagcgttttcgtatgcttgtggcactggataaagacttgaataccctttcccgccccttaaccccggtttttcatacctcggaatatgacattgacttaaaagacggccaaaccgccgaggttgccctggaatttgtgaaaaacacgaacaggatacgggtaaaggcctcgggcctacctccaggagtctcctctgagaagctggatgtcggtatccgttccagcaactggcaatatcactttgacaactccgttccccgggatgcggaagctattatctataaaccttatgaaagacaagttgataaagaggtgagtgtctctgacttgtcagtcctccgtcttatcgattccggtaaccctgttttttacattaaagatggtgagacaggagatatcctttatcagcgcaacctgatcagccttcttatgaaccttccctatacggacctggacaaggaggattattttgagatagaactggacttcgagggtccgaccattgcaataaaaataaacggttgggaaattattgacaacagccaggatgtttcctgatcagttacggtaacatttttccccaacgtatctataataatttgatatgaaaaatagtagtttacatatgctaaaaccgatacttgctttcctgctgggttggattcttgtgctctcctgttcgcaagaagagactaatccggacctaccggtaggagtgcccggcccgaatgcctccgaggcagtggtcaaattacttatcaaaggggaggctatccttcccccctccaccaggaacatgtccgatcagactgaagggagctatcaggacgagcttcagttgcttatccttgaaaaacaggcggatgacaatacctatatttataactgccaccgtcctgtggagggcacccagggcaacttcacagtcaaagtccccaatagccttgacggtaaagagttgaagttcttgctattttccaattcaaaggatatcatcggcgaccctgaccagaagttcgtggtgacggatggcacaaataaaaacgaggatgacatccgggcagccttgctgctgaccgttaacaccaagtgggagccttcgaaaaaaatccctatgtgggctgaggactctttcaccttcagggctcccacgcccggcgctccgtccgcttctgttgccacccttaaactgatgcgtatgcttgcccgtgtggatgtgggactcaattatgacggtaaggaactacactccacgtcacaggagttgaccaacttcaaactactgaaaatcaaagtctaccacagtaaaggtaaagggcagcttatgcccaatatggctgcctatgaaaccaccggtacgggttcagataaagtcatcacaataaaaacacccagtatcccggcggatgggaaaatcatcaccccttacgagattaccgttcccgcgggcagccatgccagcgagcgggacgtttacctgttcgagcaggatatgaacctgtcccaggctgacttcgatgtaaaccgtacctgtatcctggttcaaggagaatatagagctcccgctcccgcagcaggaggaacgggcactacttatacggggtggtaccggctggacttccgtgatttcggcggtgataagggttatgccgatattctccgcaacaagctttaccgtttcaacatcacgagcgttaaaggctccggcttctccacggaggatgatgctctcaacagtgtctcttccaacatgaccgttgaacttctgcctctggacctgaatcagaatgatattattttcgacggtcagagcttcctgtcggtgagcggttccgaattgtatttttataaggatctcaataccgcgaacttctctttgaccacgaactacggcaaaggctgggaaatagaggcgggcgatggatccggaattacagccactcctgcttcgggagccgctggcagttcggttgtgaaccttgcctggaatactttaccttccgcgccggcggaaaaagaaatctatctgaaggcgggcaacttaaagaaaaagctcatgctcaaatatgtgcatgaaaacgctccgggtaatctaacgagtttctcactggatccgcctttgttgtatttcgcaaagagcggaggtgtcggaaagataaatataacttctaatatcactaaaaaatacctatcccctaccttgggcaagcttgattttactgtaccctccgtaatcgaaaccagttcttttgacgtaacggtacagccctttaatcaaacttctccggagcgtatggagcagggagctgtaaacgtgcatgtccaggcggctaatgcggaggtaacggggcaaagcagcattaaccagcttacctatgataagcgggtggattgtacccctgggccgatggggcatggactggaagataagaatacgcctgccttgatggatgtcaaatatcataccagtgaagaagcaggaacctatctgatcagctttgtgccaactgatggtggggttgcatcaggtccggtcatctccaatccggtaaatgggacaggaaccgtgaaggtctcagcctcacagaataagggttccaaagaacgtgaggtgggtaaactggtattctcgccggccttaaatggtgaaaaaatttctttaatagggtatacccccaaggaggttcccgtcatacaggctcccgctccggttccggttgccagcattcgccccacgggtaatatcaccgatctggcatgggaccagtcaaaccacagttttactgtggaagtggataaccctaattttgtggagactgacaaggtgtctatcaccactcttcccaaaaacaagatgatcgatatgactgttccctcttcaggtacattgggacaacctgtcacttttaccctgaacccgaaccggggggatgctcctaagagcaggactgtgaaggtcagtgtggatggtcacggcgaccatgtgggtgagggacaggtcacctttacgcagcaagcgcccgatgtgccggtcaaggagcccgtactggctgccactcccggtaacagtctcccgtgggacgcgaccgaggctacgttgaatctaaccaacctggatcagattttcgaggtccaggccgggacggagatcgtgaacgcttctgagccgttaaatgttacattgcctgccggcggcttcaacctcactgctgataaaggttctgcttccatgaaagtcacttttcctaaaaatgatatggaggaagagcggaaagtaaaaattgtcgccacgtccatcggtaacagggagtcggtaaagaagataaaagagattatcctgacacaggctaagaaattgtttggaaagattttctttcctgaaccaactacggtagaagtaccatggacggaaaatagctttggcactgttcccctgacaatggaaagcattgatttcaatcataaggtcatatttactatggaacctgcaggagccaggggctggataagtgcggttgtaaatggaaataatatggcatattacattaccgagaatccaggattggccagaagtgttaaggtgacagcgagtgccaaagatcgttggggaaacgatgtgcgaacacccacacctctaactatgactcaaaaaggaggtcctgggagtttggaaatcataacaagagaccttacattggaacatgataatacagagcggaacttatctttaaatataaaaaggattcagtcgtctacagctaaaataacctatccctcctggatacaaaatgccaagcttttgggagacaagataatagtagaacccaaagctaatacaggggactccggtgaaagagcgggagatgtaagaatagaggccaaaggtaatgatgaagtatcggttaaaagtaatactgtgcaagtgaagcaaaaggcaaatgtcatatcagtggataacgttgaatttaagcgcgagggatatctcatcatgaaccacattttctgggataatatagctcttagaagtgattcacgaaggtttcaaagggtgcgtatactaactccagttcatcatactgatgacatatatccatctttagaaatgtatcaaggtgatcaaaagaatataagattcaagtatcgatgtcatggaaattcgtatacctatgataaacaggaaaggcaggtagagcttgagtggataagtccagaaggcagatcgaccaaatccttcgttaaaatagttgtgggaggacatcccaaatggacatttagaacagctaagggttggctgccaccgaatgaagtaccacagactcatgtaaatggcgataccttttattcggctgaggttgtcactgaaaatctacaaagggatagtcgggtcgatttgaaagtatatgaatgggccggtaatactgttccatttaaggtcgagctccttgatgaattctcgaatccgattaaaaactttgaagctaataaagcggtcaagatcaacataaagataactgtattaaattatccttcaccaaatcagggtatagcggcgagtttagctttcgagggaataggtgttgacggtagaaggaaagatctatatgtaattaagtttacaggtcctcaataaaaaactttataatgaaatattttatactaataatcgcttgtttctgtagttctttcctttatggccagcgccattcggtctcgaccaacggcgtctcttggggcacgttgagtctaaacgccgaatactctgcctgtatcgggcacaaacagagtgtacacgtacttttctcatggaatccatggacctttggtggtaacaaaaagatgaaacacttcacggtatcgcctcaatggcgatactggaagacagaggcctatctgggtcatttcctgggagcgaacctgatcggttcccgttacaacgtgagccggggtttctaccgtttcgacggtggggcctacggggctggtgcgagctggggatatgcctggctgctgagcaagcgcctgaacctggaggtacaggcagggatcggagtggtcagaaccgattataaaagattcgactgcggtatgtgcggtgattacctctcgaaagggtccaaatggtttctcatccccaaccgtttggccatatcactggtgtacgtactttaaaaaagtaaagatgacaagagtaagaatgaaacgagtagaagatacttagattgatgacgtaaagaatggaaatgaaacgaatattatggttctgctgtgtgctcttctccctgggatgcagcagcacgcgcgagttgcataagctcaagcccaccgggcagatcgccctgcctaacaggagcgatcttgacctggacagggggcaggtggagaaaatcatcacggagaactctgcgtggaaccgggagaaggggcccatcaaaggcacctataccgcccagggcgactttcagggggaagtggagttgagcgagatacagatcgttgccccttccaaacgtgtggccgaacgctttggcaaagtactgatcgagtttttagtggacgttcccgaagcgcttttccgtaaggactaccagctgacccttttccctaaactaaccagtaatgactcgctatgtgagctacgtccggtggtgctcaacggtaacgagttcaagagcaagcagcagaagcaataccatgcctacgaaaagtatgtgcaatctctggaagagaacgcccgtcaggggcgtgagaagttcctcaaccgtcggatgttttctcgatacttggaacgcaaagccctgatgcgtgagaaagagaacggtcgcaggctcaaagcctattcggcgcgcctgctatcggaccggagactgcatgagcgggaccttcttttcgggaatttcccggaccgtgtcccccgtgagtttactccccgccttttttctggtttgctctccctgctcccctatgcgcaaaagacccgtaaggagctcctgaccgaggccttgcgtacgggtaatgggccggcactggaacacgggctcagcgcgggggactccctgcacgcctacaaccttttctgggacaagcgtaagttcgagtccaacgcaaagaagatagcgcgcctggacaatacttttggaaagatcgtcgagtatccggtctacgagaacgcatatctggatacggtcgttaaccgtggtcggcataagataaactacctgtattcacttgatgcgggtgagtcctctccaaagatgctcctctcccttgacggtgcggtcacggctatcgacggtagtacgtaccatttcaaggctcgggatacgctgacctatttcgtctcgtcgatgacgactttcatcgaccgctcgccgcgctttaaacggcatatcaccctgaggcgggtacaggcgggtatgagcgtgaacctcctctttccggtaggtaaaacggatgtgatagacacgctgtcgggcaacaagcgggagctggagcgtctcaagggtttttaccgcgaccttaccggcaacgcggacctgatagtggacagcatcgtcatcttggcgggcagttctccggagggtccctggcaactgaacgaccgcctttccagagagcgtgcctcgaaagccgcggactttcttgcggatcatttccctgagaatacggaactccggcaactctcccggccctactcgctgtctgagaactgggtactgctggatacgctgctcgagggtgacaccttgctggagcatacgcacagaaaagagatcagggaactgatcgcctcccatgccgaccctgatgagcgtgagcatgccatcagacagcggcacccttcggcttacaaaatcctgaaagatgtatattaccccgggctgagaagcatctccttccagttccacctgcacagggccggttttgcccgtgatacggtttataccgatgagcccgacctggagtatgcccgtggtatcgaactgctggagaaccgcaaatacaaggaggccttgtctatcttacaggattacgcggatgctaacaccgcccttgcgcacatgtcccttggacatgacacgcaggcactggctatactggctgcgcagaagtccacggcggacgtggactacatgcttgctatcctcaacctgcggatgggtaatccggacgaagcgttgaggtactaccagaggtcgtgtgagtcagatccctcgaaagtctttaggggaaacctcgatcctgaaatacaaaagttgaaagcactgtttaatattgatgatatggattgaaatttctgaatcgctaatacgatacgtttatttagtatattctgattttaagggtgtacggttcgggaggatagtaccccctccttactactcatcaagaaaatcaactctgctttcaacttagagaaagagttttgtggttagtagaatagcgtgttaatatttatttgtttgtttttttgtgttttatttatggaagttccctacttccctgtctttatgaagaaaacgtctatagtgtgcattccatccggccggcgggatggagtgcacacttctcataaataagaagtcattcttagatagtttacagttggaaataattgtgcttttcaataaagaactgttaagatcaaacataaaaaacaaatctgtcttgtgatttgtaaaataattcggatctttttaaaataaaaatggaggagatagagctacatttgctcacgtaaattcagcaaattaactctatatactaaaaaatatcaaaatttacctggttatgcacatatcggaaaaaatgaaattgctgctactatcttccattgtcctgctgtttgcttcatgtacagccgaagaagagtttaaagagaatagaggaattctattcagtgcccaaacacgtactgataattctacaactgagtacgcgaacctacagcctggagagcaggtaggtgtatatatcatagaacgtattgaggcaggtgcagaaacttcacttaaacctacgggaaatattttcgataaccttctcttatcttgtcagtcagaaggaatactcaaacctcaaaatgaaacctattatccgttgaacatcagctatgtagatctttatgcctatgctccatacgatgcggcaacagaaatagattcaaatcggttactttcatttttcgtacagcaggaccagtcgtcttccggtttaataagaaagtctgatttattatggtcaaaaaagttaaatgtttcgacaacttctgtatcagctccttccctgacattcaatcactgtctgagcaaactgatcattaatctgaaggcaggggtaggagtcacattagataatacagccgtcaagataaccggaaccaaaataggtgctaagttaaatatgattgatggaacgcttgccgaagcccaaggagatgtggtagagattactcctatggttcatgccggaaagtttgaatatgaagccatcatcattccacagaccgttactgagggaaccaaactttttaatatcattaataatggaaaaacttattattgtacggtgaaagattcaaaagagttcaatccgggaacaaagtatgcatacgatatcactataaacgcggatgatttgaaagtagaaatgactggtacaatcaacgaatggaatactggagaaaccactacagaaaccattagttagtaattaacttcacagaaaaaaaatgtttaaattaggcttactatctctgacttgtctatttctgtttgttgtgtgtatatcatgcagccaaacagatgatgaacaaactccggacgaactgtctacgaacctctctgtatctatgcatggcatgacattttccaccaatgctgcggaccgtatccatcatgcaacggtttatttcgtagatgtcccgaacagtatctttataaaaagccagaaaggcactgtttctgaggatggcacgaaagttagtatcaatacaactttctctgcggattacaggggtaaagaaatacaagcttatttcatttctaacgcttcggagttatcagatccactgaatatacagccggggacatcgttggatatatccagatttgcgaacctcacaacccgggatccgctttacggcactaattcccgatacacaatgagcgcaaaagtaacttttcaagcgggtaatgtacagattcctgaaattaaatttaacagaacttttgctaaagtgtatattgttccttcttcggatatggatatcgaacagcaacgtaagatacggttagtatccgcccaaatcgtatcggccgccgctgaaggatacctttttaaagaaggtgtagtaaaaaaacgggctgatacacgcactattgtggttgataaaacgcttgacgggttgaataacgctccgctttgttatctttatccggatgaggaagatgcacacttaactgtgacacttcgcaatgagataagcggacgtgttataaccagacgtgtcatatttcgtccacagaagaataccgctcacaagctgaccattttgtctgtaccagatggaaacagcgactactccatcacagtcgcagattgggatgccgatatattacttcccgacacagaaacatccgagtcttccgaaatacatgtagaagagggtattgacctaattaatcggtcggaagtttattactattacaacctgctgaatgattcggagaaagaactttatcgtagcatattccacataacaaataatttcacagaaactccacctgttggtggacgcttggaaattgaattgccgcactctttacaaggtaaatttgccagagaagatttcaataaggtaacggaatacttatggaatgatatgccggttttgtttaattcaggtcgcgccataccataccgaatgagttccggaaaagtgcatacctatcgcttagggtttaacgcagatcgtgcaaggtatgacatgagagttgggttagtgataaaagccgctcgggagttcttggatactcttgaaccgggaaagagtgaatgcgaaattgttaaaaatgttcatgataaattcctgagaagcgttagttatggaggaatgacatctgcactaggaggtaatatcgtcggaggtctggtggataaaaaggctgtttgcgaagggtattcggcaacatttcagtatctattgcagcgctgtggtatacaagctctttttataggtggagaggtcatttcgagcaaccgtcctacgcctcacgcatggaatatcgttcggatagaaggaaaatattattatgttgactctacctgggacgatggtatggttggtcttcctcccgattttgtccaatacacatattttctcaaatcaaaaaaaacaatggataaagaccatacggtcagaatgaatatcccgataccaggctgccttgaagattatccactaaatttttaatagatgataacaaatttactaaaatacgcttgtgctttattcgcttttattcttttctcctgttcagcagatataacagatatatctgggcaagaagagaagcctgtcgtgaaaacagcctttcggcctatagcacataccggattcgcagatatctatgaagaagaggtgcttacaaaagtatcccctacaatctcggaactcctgaaccaggtgagatacattgtctataatgcatcaggaaatatcgtacaagaaaaaaagttgacttccaccgaaatcgaagatggtttccaagtgatgttaccttcaggtgactaccggatctgcgtattgggagaaggaaggattgtaaactacattccagtaggaacaatatctgatgaaatcaaagaaagtccttattttaagtccgtatgggtttccacttatcagaatgcacgaaagcctgtatatcgtgactatttttttggtgtattaaaatttattgcaggagcacaggggattaatcccattgtactcaaaagagcgacgggaatgctgcaagtagaagtaaaagagaaggatagtgatataactattcatgatatatctgttggattcctacaaaacggaatacagaacaattttcatacagatggaacttatagttgctctaaccaacaatttccaacttcaagtgagccttacgcagttcaccattcgctacgttatgtttcacaaaatgactattttgaaggaatttatttctctaccgcaacgggaagtatcacatgcgatctcactattagttatcagaaagaaggcaaaatatatattcgggaaataaaaatgaatgacttcttgatagaacctaataaacgtacccgattgccaataataatcaagaaataaagaaaaaatatctttttgtttatcttctcctgaagttttgtctaattttgaaatatttaattcaaatagcatgtcttttagatcttaggatgtttgtttttcagttatctgtaagatagtctgtccagaaatagctttacgctttatatagttgttgctgggtgaagctgttttaagacaagtcaaatatcgaaagtcatttattggatatgtgacagacagattttaaatgatctgctctctttataatatgtatccgctcttttcttctctgtttacgaaatatttttatctctaaataatcactatttacatccatataaactctcgtatttgcattatattccatattctacgtttattgatttctttgaattaatatatatatgtatttttgattcacttttatatcataatgaaaagaatgattatatcaatcaagaagtgaagtttttactctctatgaaataatgatgtaattaaatagtgataggtgtatcactgttttcagtgacaaaaatgtatttaatatcgttgtatagtggtaaatggtgaagtgaataatacgtaattgataaattttgaaatattttttctgttaagtatttgaaataataaatctatgcgctatatttgctgttacactaaaagatactaaataaataattgcttttattaaaataatgttaactgtttggccgacgatattggattcttatttaaagaattcaataagagaaagagaaagtatatttgataataaaattttatagaggtattacacttacataacaaattactttattataggtacaagaatattgggggagatgcgaggatattacagtaagtcaagcttgacattattattgctcaaatatcagttgaaaaacgagatttatacaggataagctgcattggatgttttgttcactgaataataaccggaattgacgttaatataaaagttctatatatgaaaaaaatatatctgttattatcatttctttctgcattctttttgctctcggcttgctcagatgatactgagcaatgtttatattctcctgaggtatttgataccggtaatttattgagtaataaagtaaaagaggaattcttgaattttgattatcctgctggaattgttccggttctttttgcggcagatagcatagagcccattaaaatgggtgcttatgctgacgaatgttttgatgctcttgtggattcaatatctgaatcaaaagattttaaacgtaggggaatgctggtacttgtgtccaggaatccggagttgattcaaattcgtttggggagtcggtatcgggtttattgtaatatgactggcgcaacttctggagtcgattacttaaacttgcagaaacaaatacgggaaaaaggtatagaagaaactcttccgttgtttttacaaaatacatcagttcgcattcaagagttgaatgctttaccttcgtataaaaaatatcgaataaattcggccgtatcggctatttctacttgcctggaatacataggaactccctcggagaacttttatggaaaatgtgttttaactcctattctgaagacaacgtcattggggtactatgtttttaaatcttggctgctgaccttcatgtttgtatgtctgataatgcttttgtgtcgttgggcattgtttttagtagtgaagcgtttattgcagaaacatgttataggtcttatttggtctcaaaagattatcaattggggattaagattgttgttttctatttcagcagcggcttcggctattattttatccagcggacgtatggaagatgcgatcgcattacaggccatcggagttccttttatagaaaattttcagatagcggctgccgattatgtgttgaaaacatcttttgtggctgcgttcttttttgtgttgatgtatgctttgaaacgtaatatagtatcagatatatttttatatagcctcttggaaccagagaagcaacaggctatttatcataatttgagtgatgctcaaaagactactttggttatagggcatgaagcggatctcagcaaagttgaagaaagttctgagccatattccgaattattcacttctcgtgtttcccaacgggaaaccatgactattgtttcgttggcgatggcagctttatttctgataccgcgtccattgataattatgggcattgctttaaccatttatcctttggccggacaatgtgtgaagatctatcatgttgtaagtaataatacacttcctgaacaaataaaaaaagataggaggacatcgttaataactaatttgcttatcatttttattatagcttttattactgttttgatgggattgttttttaatcccatgccagataaaaaagagattgatttaaatgaggcaagaaccgaactggtcacatcggataggcttgaggggaattataccgttagtaaatctattgccggacaggttcaggtatccagtggaattataaaaaaaataaaaaatggtgcgtttcaattattgataaccggcaagtcttcacctaaagtgtacaaacttggttttgactctgatgaaatgatatttgtttctgaggaattgggtaatgggatcattcattatgacaaagatttggataaaattaaagttgtatttactataaatgaacatacgacatggacaatttcaaaatgatttattcgattccatttctgttttttacttttgtatcttgtagtaactcgtcaacagaaatggttgctaaaagtaagtatgatgctcaaattgctgagtataaagagttaaatgaacagcaagctgctgttatagaagataacttagagaaaagtaagatcatcaataatgtagtgacagagttgaaccaaatagccgggaatacgcaatctttacgtgtgaatgtagaacatggggtcggagaactaagccaggctgaagagattaaccggaaactccagattttgaagaaacgattgaccgctgtcgaggggaagcgtagtgacagcagtaagaatctgttggcaacgatggataacctgaagagtattataggacaaaaagaaattgaaataaataatctcaaacaagagattgcgaatcaacaacagaccattgctaatcagaaaaacacaatagctaatcagcaggtaacgattgatgcccaaagtcaggaactgatggctaagcaacaggaaatgtggtacaaattaggtgttgaactgtattcagttgtagaagaattgccaaaagtgaaaggcaggaaggataagcgaaacattaaaaacaccagatattatattcttaacaaagcaaaagagtgctttgagcatgctgcacaattgggacattcgctcgcaagttcgaaagccaggcagatagaaggtgagatgagcaggttataatgcgtgattttattgtttttctgtttttaagttagtagaaaacattaattttgcattcgatttaaatccgattcgaatgtcacaacttccaacgttaatagccgacctcgctctgattttgatttgtgccggtgttatgactttgttattcaagaaactgaagcaaccgcttgtgctgggttatgtcgttgccggttttcttgccagtccacacatgccttatacgccttcggtgatggatacagccaatattaaaacctgggcggatattggagtcatctttttgctttttgcccttggattggaattcagttttaaaaagatagtgaaggttggaggtacggctgtcattgctgcctgtaccattatcttctgtatgattctgttgggggttgctgtcgggatgagctttagttggcagcgtatggacagtctgtttctgggcgggatgattgctatgtcttctactaccatcatctacaaagcgtttgatgatttggggttgcggaagaaacaatttaccggtttggtgctcagtattctgattcttgaagatatacttgccattgtgttgatggtgatgctttcaacgatggctgtcagcaataattttgagggaacagagatgttgagcagtatcggtaaactactttttttccttattctttggtttgtggtaggtatttatgccatacccgaatttctgaaacgttgtcggaaattgatgagtgaagaaacattgctgattgtttctctggctctctgtttcggtatggtggctatcgctgccaatacgggcttttctgctgcattcggtgcctttattatggggtctattcttgccgaaacaattgaggccgaatctattgaccgattggtgaaacctgtgaaggatttgtttggagctatcttcttcgtatcagtgggaatgatggtagatcctgcaatgattgttgaatatgcagttccaattatagctattacattggcagtaatcttgggtcaggcttttttcggcacaatgggcgttatgctggcgggacaacctttaaagacagccatgcagtgtggttttagtttgacacagataggggagtttgcttttattatcgcttctctcggtttgtccttgcatgtgacaagtgattttttatatccgatcgtagttgctgtttctgttatcaccacatttctgactccttatatgatccgtgttgccgagccggcttcaaattttgtagaccgtaagttgcccgagtcgtggcgacgtttcctgatgcggtatactaacggttcccggaccgtcaatcatgaaagcctttggcggaaattactgtttgccttggcacggattctggtggtttactccattgtcagtatttctgtgattaccctttcatttcgttttgtggtgcccttgtttcgtgaacatcttccgggtatctggggaccactggcgggagctgtttttactattttgtgtatatctcctttcctgcgggccattatggtgaagaaaaaccattcggtagaattcatgactttgtggaatgacaaccgtgtcaaccggggacctttggtttctacaattgtgtttcgtgtagctgtttccgttctgtttgtcatgttcgtgattacccgtctctttaaagcgtctgtcggattgatgttcggagttgccttgttgctggtaatcctgatggttctttcacggcagctgaagaaacaatctattttgatagaacgtaaattttttcaaaatctccgttcccgtgatatgcgtgccgaatacctgggggagaaaaagccggcttatgccgggcgtttgttgtcgagagatttacacctgaccgattttgaaattcccggagaatcggcttgggcaggaaaaacattgcttgagctgaatttgggcaaaaagtatggagtacatgttgtttctattctacggggaaagcgtcggattaacattccgggaggttctgtccgtttattcccgatggataagatacaggttattggtactgatgatcagttaaatacatttgcagaggaaatgtctcatgtttctgttatcgattgggatgtgtttgagaaaagtgaaatgacattgaaacaattgttgattgatactgattctgcttttctgggcaaaacgttgcgtgaatcaggtatccgggataagtaccattgcctgatagccggtgtggagcggggaggagaggctttgatgactcctgacgtaaatattccttttgaagaaggagatgtggtatgggtggtaggtgagaatgaagatgtataccggttaatagggcaaaattgtgatagaaaacgttaacaggatactggcatatcataaaaaaatgcgatatttgcgaaatgattcagatagagactatacttgatatacttgttaaaggattcgtgattggcattgtggtttctgcaccgctggggcctgtaggtgtcctttgtattcagcgtactttgaataaaggacgctggtacggattcgttaccggtctgggtgcttcgttgagtgatattgcttacgcccttctaacgggatatggcatgagtttcgtgttcgattatatcaataagaatattttttatctacagcttctcggaagcattatgctattggtttttggtatatatacattccgtagcaacccggtacaatccatccgtccggtatcagccaataaaggttcttatttccacaatttcatcaccgcttttgcggttacactttcaaatcctcttataattttccttttcatcggtttgtttgcccgttttgcatttgtgcaacccggtgtgttggtttttgaagagataaccggttatctggccatagctctcggagcattggcatggtggttcggaattactttctttgtcaataaagtgcggacacgattcaatttgcgtggcatctggattctgaaccgggtgatcggaagtattgtgatggctgtgtctgtgtttggattgatattcactctgttgggggaatctatctattaatgtaggagaaaagaaagaagatgaaaatagcgcaacaactgaaagaaaagaatattgccgagtaccttatatatatgtggcaggtagaagatctgatccgtgccaatgattgtgatatcgaccggattaaggagaacattatatcccgttacaagattggcgatgaagaacgccgtgagttgacggaatggtattctaatctggcttcaatgatgcgggaagagggagtccgtgagaaaggacatctccagataaaccgaaatgtaatcattaacttgaccgaactgcatgcagctttgctggcatcgtctaagtttcctttctatagttcgtcttatttcaaagcactgcctttcattgtagagttacgaaataaaaacggtcaaaaggaagaaccggaacttgaaacctgtttcgaggctttgtatgggatgatgttattgcgtttgcagaagaagcctatcagcccggagactacaaaggcgatggaggctatcagcagtttcctgtctatgctggctaactattacgacaaggacaaaaaaggagagttaaaattggaatagaaatgaatacgattcaccacagagtacacggaggacacagagttttaatctcttgtttattaagatgtttaagaaaaagatattctctgtgttctctgtgttctctgtgtcctccgtggtgaattaaactcaaaaaaagatagaaatgaatatattagtcaccggagccaacgggcaacttggtaatgaaatgcaggtgcttgccaaagaaaacctgcagcatacgtacttttttacggatgtgcaggagttggatatttgtgatgaacaagctgtttatgcctatgtgagtgaacacaaaattgatgtcattgtgaattgtgcggcttatacagcggtggataaggcggaagatgatgctgaattttgcgacaaactgaacaatgtcgcaccaggatatttagctcgggcggcacaagccaacggagctgcgatgattcaggtttctaccgactacgtgtttgatggcacagcccatatcccttacacagaagatcaacccacttgtccgacctcagtttatggctctaccaaattgaccggtgagcagaacgtgatgaaccattgtgaaaaagctatggtaatccgtacggcatggttgtattctatctatggcaacaattttgtgaaaacaatgattcgtttaggacgtgagcgtgagtcttttggggttatatttgatcagatcggtacgccgacttatgccaatgacttggctctggctatttttgcagcccttaataaaggtattgtccgtggtatctatcactttagcgatgagggagtttgttcttggtacgactttacaatagccattcatcgtttagcgggaatcacttcatgtaaggtgaaaccattgcatactgctgattatccggcaaaggcacctcgtccgcattattccgtactcgataagacgaaaataaaagagacatttggcattgaaatcccgcattgggaagaaagcctgaaacgttgcattaatcaattaagagtggagaatctgtgattcttcatcctcaattcttgaaatatggcagataatacagaaatattaagaaggcgcactttcgccattattgcacacccggatgccggtaagacttcactgactgagaaattgttgttgtttggcggacagatacaggtggcaggagcagtaaaaagtaacaagattaaaaagacggcgacttccgactggatggagatcgaaaaacaacgtggtatctcagtcactacttcggtgatggaattcgattaccgggactataagattaatattctggacactccgggacaccaggattttgccgaggacacataccgtaccctgacggcagtggatagcgttatcattgtggtagatggcgcgaagggtgtggaaacccagactcgtaagttgatggaggtttgccggatgcggaatacaccggtgattatctttgtcaacaagatggaccgtgaagggaaagatccgtttgacctgctggatgaattggaagaagaactgatgattcaggtgcgcccattgtcgtggcctatcgaacagggtgcccgtttcaaaggagtttataatatttacgaacagaaactcgatctttatcaaccctctaaacaggtggtaacggaaaaagtggaagtggatattcattccgaggaattgaacaagcagattggtgatacgttggctgataaattacgtggtgatctggagctgattgaaggtgtgtatcctgaatttgatgtaaaaacttatttgcagggagagtgtgctcctgtatttttcggttcggctttgaataactttggtgtgcaggaattgctcaattgctttgttgagattgctcccgctccccgtccggtacatgctgaggaacgtgaggtgattcccgaagaacctaaatttaccggttttattttcaagataacagccaacatcgatcctaatcatcgttcatgtgtggcattctgcaagatttgttctggcaaatttgtaagaaatgcgccttatttgcatgtgcgccatggcaagacgatgcgtttctcttcgcccacccaatttatggcacagcgtaagacaactatcgatgaggcttgggcgggagatattatcggtttaccggataacggaacgtttaagattggcgatacgcttaccgaaggcgaacagcttcatttccgtggtttaccgagtttttcaccggagatgttcaagtatattgagaatgccgatccgatgaagcagaaacagcttgccaagggcatcgaccagttgatggacgaaggtgtggcccagttgtttgtcaaccagttcaatggccgcaagattatcggtacagtggggcaattgcagtttgaggtcattcagtatcgtttgttgaacgaatacaatgcttcttgtcgctgggagccattaagtctgtacaaagcatgctggattgagagtgatgatctggaagaactggaagcattcaaaaagcgtaaatatcagtatatggccaaagaccgcgaagggcgtgatgtctttctggccgattcgaattatgtgcttcagatggcacagatggatttcaaaaatattaggttccactttacgagcgagttctgattcgctttacgaaataaattggattaagacggtgggcgggttgcagaacagtgtaacttgtccaccgtttgttctctttctgactaatataaaaacaccttgttaacgcattcttatggtataattttccctaaataaggggcgatgttgccttaaaaattttacctttgtaatctaaacaaaaactcgaagtcatgaagtataaattgttagtccttgatgtagacgggacattgcttaatgatgaaaaggagattactccacgtaccctcgctaccttattgaaagtgcagcagatgggtgtacatcttgttttagcatcgggcaggcctacctatgggattttgccattggctaaaaaactggaattgggtaactatggcggatatatcgtgtcttataacggtgcgcaggttattaatgcaaaaaatggagaagtattgcttgagcggcgtattaatccggaaatgttgccctatttggagaaaaaggcacgtaaaaatggattttctatctttacatacaccgaagatcggatgattgccgattatgctaataatgaacatattctttgggaagcacgtctcaatgggatggagctgattgaggaacccgaattttcggcagctgtagattttgctccttccaaatgtatgctggtcagtgatgatgaagaagcattggtagctttggaagaacattggaagaaacgtttgaacggtgcactcgatgtattccgttcggaaccttattttcttgaagtgttgccttgcggtattgataagtctacctctttgggagcactgttgtcccaccttgatattacacccgaagaaacgattgtgataggcgacggtgtctgcgatgtttcgatgatacagtttgccggattgggtattgccatggggaatgcccaggactctgtgaaagtttgtgccgatgtggtgactgcatcgaacgaagaagacggagttgcccttgccgtagaaaaggcgattcttgcagagatccgtcctgccgagattccacttgatcagttaaacgagcgtgcccgtcacgcattgatggggaatctgggtattcaatatacttatgcgtccgaggaccgggttgaggctaccatgccggtagacgaacgaacccgacagccttttggcattctgcatggaggggctactttggcattggccgaaactgtagccggattggggtcgatgattctttgccagcctgatgagattgtcgttggtatgcaagtcagcggtaatcacatgtcatctgcccacgaaggagacacggtgcgggctgtcggcaccatcatccataaaggtcgttcatctcatgtctggaatgtggacgtatttacgtcgacggacaagttggtgtcttctattcgggtggtgaatagtatattaaagaagagatgacgtcagaagaaacaaataattgtgagattatagatgagttgatccggcagggaagaagttttgcgatgtatcgtaatccgggggaagaagaacctcactttctgatgcagacttacggagaagtacgtttggttcgggaaatggaagaactaaacggacagacaggttttgttatcgctccttttcgggttactccgcaatgtcctatcatattgattcaaccggactgtcaagaaattccttcctgtgtaggcagcccgcgcaggagtgtgcagcctgtctgcacagaggtgtgcacccggtctgcacaaaacgaacggcctgtgagagcaaaggaagcttatgcagcctgttttgatatttttatccgggctttacgggcacatactttcgataagctggtgctgtcccgcaaagtgacggtgaagaaagaaccggggttctctcctgcaagcgctttctataaagcttgcaggcgttatatttactcctatgtctatctttgctatactccgcaaacgggagtgtggatgggcagtacaccggaaatcattttatcgggtgagaagggagagtggaatactgtggcattggccggaacccagtctttacaaaatggtgaacttcctcagcattgggatgagaagaaccgggaagaacaggaatatgtagccgcatatatccgtaatcaactccgatcgttaggtatttctccggtggagaagggaccttatccggcttttgccggagctttatcgcatctgaaaaccgatttccgtttctcactgaacgatagtcgtaaattgggggatttgttgaaactattgcatcctactccggctgtgtgcggattacccaaggaggaagcctatcggtttattctcgataatgaaggttatgaccgcagttattattccggatttatcggctggctcaaaccggaggggaagacggacctgtatgtcaacctacgctgtatgaatgtgaaagaggatactctgacactttatgccggaggtgggttactggcatcttccgaattggatgatgaatttcaagagactgaaaagaagatgcagacgatgaagaacttgaactctttataaataacttaatagagcgatgtattcagataaggaaaacatattgcagttggtagcgttgcttcgggcacacggagtgacgaaagtggtcttatgccccggaagccggaatgctccgattgtacacacacttgccggacatcctgatttcacctgttattcggtaacagacgagcggagtgccggtttttttgctatcgggcttgccttacatggcggaaaacctgcggcagtctgttgcacatccggtacggctctgctgaatttgcatcctgccgtggcggaagcctattatcagaaagtacctttagtagttatttctgccgatcgtcccgcagcctggattaaccagatggatgggcagactttaccgcaaccgggtgtctttcagtcgttggtgaagatgtctgcgaacttgcctgagatacataccgacgaagacaaatggtattgtaaccgtttgctgaacgaagcattacttgaactgaatcaccatggcaaaggacctgtgcatattaatgtaccggtttcggagcctttgttccagtttacggcagatgttcttcccgaagagcgtgttataacacgttatcaaggactgaatgtttatgatcgcgattacgacggtctgattgatcggcttaataaatacaaccggcgcatgataattgtcggacagatgaatctgatttacctgtttgagaagaaatattcaaagatgctgtataagcagtttgcttggtttaccgaacatttgggtaaccagactgttcccggtattccgatccggaattttgatgctgctttatatgccatgtctccggaaatgcaggaaaagatgatgcccgaactggtaatcacttatggaggacatatcgtctccaagcggatgaaaaaattccttcgtcaacatccgcccaaggagcattggcatgtgtcgacggatggtgaagtgattgatctgttccaaggttcactcacgacggtcattgaaatggacccgtttgagttccttgagaaaatagctttcttgctggacaaccgtacaccagagtatcctcggcaatgggaaaatttttgcaaagaacttccccaaccagagttgccctattcggagatgtctgccataggagcgttgataaaggctttgcctgcttcatgtgctttacacctggccaatagttcggttgtacgctatgctcaactataccctttacccgatacaatagaggtttgctgtaaccgtggaacaagtggtatcgaaggttccttatcgacagcagtcggttatgccgctgcctccggaaagttgaattttgtggtcattggggacctgagttttttctatgacatgaatgcgttgtggaataatcatttcggaagtaatctccgcatacttctcttaaataatgggggaggagaaatctttcatactctgcccggcttggaaatgtccggcacttcgcatcgttttgtgactgccgtacacaagacgtctgctaaagggtgggctgaagaacgtggcttcctctaccaggaagtgcaggatgaaaatcagctggacgaagcaatgaaggttttcacccaagccgagttattgactcagcctgtgttaatggaagttttcacaaacaagaataaagatgcacgtattttgaaagactattatcatcaactaaaaaaataagattatgattaagcaaggggtgatgttgattggtggcttattgctgtttgttataagcccacttgtggagaaggttggggccatgtcttccgggaataccgtattacaggaggtgacggctcatgtagatacaatcgattttaggttggcctctgccgaagaagctaaacgcctgatagtggttgaggatcattatacgcgtaactggactccgtttgatattgcagcccgtcttgagaatcccgaaggaaaaagagaagatctcgtcagtctggctattggtgaagttcgtgaatggactccccgggaggcgcaacagattgaacggatcagaaaaagcctgaatgacacgattcgtaagtatggttaccggattcctttcccgaaagaaatagtattggtaaaaacaacaatgaaagatgaaggaggagccggagggtatactcgcagtaactggatagcactgactgacgttacttttcagcggggaaacgagcagtcgcatactcgtctgttggtgcatgaaatttttcatatcctgacacgtttcaatcccggattcaaaaagaaaatgtacgaggctattgaatttaatattctgccaaaagagattgaattgcccgaagatattcgggaataccggatttccaatcccgatgtcagccgttgggacagctatgccacttttacaatcgatggtaaacctcagaattgtaccatggttatatatgccaacaggccctataccgttggtaagttctatcagtatatcaatgtcggtttgattcctttggataaagcattcaaaccagttcgggaaaatggcaagacagttatttatccgttgcagaaagctgccgacttttttgataaggttgggcggaataccggatacgttatcgatccggaagaggtgatggcagataatttcgctatcgcaatgttgaacaaccccaatgtaaagacacccggactccagaagaaagtacaggaattattaaagaaataaccattaaaatgaataaagatggaaacgaaaagagagtggactcctattaaagaatatgaagatattctatttgattactataatggcattgctcgtattacaattaaccgcgagcgttatcgcaacgctttcacaccgaccacaaccggtgagatgagtgatgctttgcgtatttgtcgtgaagagcctgacattaatgtcgtggtactgaccggtgccggtgacaaagctttctgctcgggaggtgaccagaatgtaaaaggacgaggcggatacatcggtaaagacggggtgccccgtctgagtgtgttggacgtacagaagcaaatccgttcgatacctaaaccggttattgccgctgtcaacggatttgctatcggtggcggacatgtactgcacgtagtatgtgatctttccattgcctccgagaatgcaatcttcggccagaccggaccgcgtgtaggtagctttgatgcaggattcggctcttcttatcttgcccgtgtggtgggacaaaaaaaagctcgtgaaatttggttcctttgccgcaagtataatgctcaggaagctttggatatgggacttgtcaacaaggtagtgcctttggaaaaactggaagacgagtatgtccaatgggccgaagagatgatgcagctcagtccattggcgctccgcatgattaaagccggcttgaatgccgaacttgacgggcaggcaggtattcaagagttagccggtgacgcgactctgctttattatcttaccgatgaagcacaggagggcaagaatgcattccttgaaaagcgcaaaccagattttaagcaatatcctaagttcccataagtaaaaaaggccttcttgatgggaggcctttgctttatagtattcctatgtatacaataaatattattccccgtatcctccatttcaagcagccggcaggaacttcccgcggtacctatactacccggaaggtttggtatatctatctttctacgacagagtatccggaacgtgtcggagtgggagagtgtgctccgttgcctaaactgagttgtgacgacctgccggattatgaacaaatactctgcaatgcttgccggtgtttggagcagacaggcgaactggatacggaagctttgcgtgattatccttcgattctgtttggacttgaaacagctcttcgtcattatgaaactcagagttgggcattatgggatactcctttttcccggggagaaaccggtatacccatcaacggacttatctggatgggcgattttgataggatgttgcaacagatcgaagtaaagatgcagtcaggataccgttgcatcaaactgaaaataggtgcgataaacttcgaagaagaattggcactgctgaagcatatccgtgctcattattcggcgagggaaatagagttgagagtggatgccaatggtgctttttcacccgttgacgctatggaaaaactgaataggttggctgaattggaactacactccatcgaacagcccatccgtgccgggcagtgggaggaaatggcccgcctgacggcagacactccgcttcccattgcattggacgaagaactgattggctgtaatactcccgaaggaaaacaagatttgttgacgtctgtccgtcctcaatacattatattgaaaccatctttacatggtggaatcagtggtggtaatgaatggattgcagaagcggaaaagcagcatatcggttggtggattacttctgcactggaatcgaatatcggactgaatgctattgcacaatggtgtgctactttccgtagtccactgcctcagggattgggaaccggactgttgtttacagacaatatcgaaatgccccttgagattcgaaaagattgtttatggttttgtaaataaaagaaatacttatgatatttaatcgggaagaacaacagctgatgctggaaggcaatttgctttcccgggaagatgtaaaaagacttgttgccaattgtacagacgcaacgccggtatttctgtgtgaactctaccgttttctggacgattggttcaacgattctccttatcttactgtaaagacgtccggttctaccggaacacccaaacaaatgaaggtccttaaagaccggatgatgcagagtgcccggttgacttgtgagtatctggggcttcggcggggggatagtgcgctattgtgtatgcctttgcaatacattgccggaaagatggttgtggtgcgggctttggttgccgggctgaatctggttgtccgcactccttccggtcatccgatggcggatttggatcagccgttacgtttctcggcaatggttccgctgcaggtttacaatactttgcagatagccgcagaaagagaaaggctctgccggaccgatattcttataattggcggtggtgcgatagatgccggcctggaagctgagatacgccaattaccgggtgaggtgtattctacgtacggcatgacggaaaccctgtcgcatattgctttaagacggctgaacggaccggacgcgagtactctttattatccttttccttcggtacgactttctttgtcacccgagcatacattgattattgatgctccgctggtttgcgatacgattttggtgacaaatgatgtggcggaaataaattcggacggtagcttttctatcctgggcagaaaagacaataccatcaacaccggaggtatcaaagtgcaggcggagcaggtggaagatatactgcgtccttggatacatgttccctttgccatcacttccgtttccgatgccgcattaggggaggccgttgttcttttgatagaaaatggagggtatacggaacggttggaggagaagatgaaagagcttcttaccaagtaccagttgcctaaaatggttttttcagtgggcactatacccttgacggaaacagggaaaataaatcgtgccggttgccggcaattagctgctacttatcaggtggggcgttaagtgttttttctttttcagttgtatcatatacggaatggctttaaatttaataaccaacacatataaactaatgaataagatttgcttttttatcggagcttttattaccctgcttctggcgggttgcagttccagtccgatttcacatgtccgtttggctaccttcaacatccgttacgataatccgggcgatagcctgaattcttggaaataccgtaaagaccgggtttgtgagtttatccgtgaaaaacaaccggatgtactgggtatgcaggaggtgttacatcatcagttagaagacttgttggccggactgcccgattatgcctatgtaggcgtgggacgtgaggatggaaaaactcaaggtgaatatgctccggttttctatcggaaagataaatatgacttactggacagcaatacattctggttgtccgaacatccggatagtgtcggtaaacttggttgggatgctgcctgtacccgtgttgccacctgggctaaactgaaggagaaatccaccggaaaagaattcctgatggtaaatactcattttgatcacgtagggacagaagcccggaggaacagtgcattgcttattattgataagataaaagagatagccggtacacacccctctatgatgaccggagattttaatgtttctgaggaatgggaagcttataaaacaattacatccaatgagttcatattgaaagatgcgtggaagatagctgcgaaacagacaggagaaagctatactttccatgattttggaagggtaccggtggctgagcgggagaagatcgattttattttcgtaactccgcaaataaaggtggcggatgcggaaattatttcttccgcgattacagactctacctatttgtctgatcacaacgcgcatttggccgacctggaattctaaaccacataaacagattacatgaccatgaaacaaaacttgcatttgttatttgtcgcttttatactgatgagtttttatagttgtactccgaagactgagttatcctctccggacggacacatcaaggtggcttttgcaacagaacctgacggaaagatggtttatcgggtggcggtcaatgatactcttttgttggacaactcatcgcttggtttcgaggcgaaagacgggatcgaccttaatcaaggatttcgtgtcgtgaaaactacgtttacagataaagatgaaacctggacccaaccgtggggagagaataagacgaacaggaatcattataatgaaatggcggttttcttgaagaacgatgccaatatagagttaactcttcgttttcgtgcatttgatgacggtatagcttttcgttatgaatatgaggtgcccggcgttgactctttgctcgtcaccgacgaattgaccgctttccgctttcacgaagatggaatttcctggtcaattccggccagcttcgaaacctatgaattgttgtattcggaacagaagatcagtgaagtgaagaatgccaatactcctttcactttcaaaactcccggtgggatatatggcagcattcatgaagctgctctttatgattttccggagatgacactaaagcaggatggaggtcatgctctaaagtcggaacttgcttcctggcccgatggtatcaaggcccgtaaagggaataatttcatgacatcatggcgtaccattcagattgctccggcagctgtcggcctgattaattcgtccttgattctgaatttgaatgaaccttgtaaactggaaactaccgactggattaaaccgattaaatatgttggcgtttggtggggaatgcatctgggggtagaaacctggaagatggatgaccgtcacggagccacaaccgccaatgcgaaaaagtatatcgattttgctcatgacaataatatcgaaggagtattattcgaggggtggaacgaaggctgggagagctggggtggtatgcagaattttgattttaccaaaccgtacgctgattttgatattgatgaaatagtccgttatgcacgtgagaaaaatgttcagatcatcggacatcatgaaaccggaggaaatattcccaactacgaacgccagatggaaaaagcgatcaagtggtataccgaaaaaggtattcatatactgaaaaccggttatgcgggtgcttttcccgacggacattcgcatcacggacaatacggagtcaatcattaccaaaaggtagttgaaacggctgctcgttaccatatgactttggatgcgcacgagcctatcaaagatacgggaatacgccgtacctggcccaatatgatgactcgtgaaggtgctcgtgggatggagtggaatgcctggagtgagggaaatcctccttcccatcacgagatgttaccgtttacccgtttactgggtggcccgatggattatactccgggtattttcgacatattgtttacacagacgaaagattctcctaaacgccagaagtggaatgaccaggataaaggcaatagccgtgtcaatacgacactggccaaacagttggcaaattgggttatcttatattccccgttacagatggcttctgatatgattgagcattatgaaggacatcccgctttccagttctttcgtgatttcgatccggactgtgatgaatcaaaagcattggccggtgagccgggagaatttgtagtgatagtgcgcaaggctaaacagaattatttcttgggagcctctacgaatgaggaaccacggactttaccggtcagccttgattttctggaaaaggggaagacttataaagcaataagctatgctgatggcgagcaggctgactggaaaaccaatccgaccgaatatcagattacggaacaggaggtgacggcaagagacacaataaatatccgcatggccgccggtggtgggcaagccatctcatttatgcccttgcagaaatagaaacagcatgataagagggaggtagtccttcaattccgaacgcaatattttcagggcttgccctatgcgataattgacagtttgcggagagacgtttagtttctccgcaatttctttatgagtcagttgttgatttcggttcatttcatatgcctgacgaaattctgccggtagctttcttaaagcctcttcatacaacctgaaaagttcgttttccagataaaagtcaggtgaagaaaattcgctttcatatttttcggcaatttccagatgtaccttacgctttatttcgaaatgggagattttattaagtgccttgttcttgacaatagtaaaaagaagagtttttaaggttagttccggaatgagggtttttctgttttcccataaccacatcatggtgtcctgcacgatttcttccgattcactcagtgtgacgtactgagaacaaaagacgcatagtccgcgaaagtaatggcggtaaacattgtcaaatacttcttcgcacccttctctcaaggctgatataacggcattattatcatttatgtttaggttagtcagagtctgtgccattctttttttcattgttattagcgaacaaacgtagctaaattttcggtactgacaaaatgattcttcgaagaaaaaaagtttgtgtttttatttagtaactttgctttctgaaatgtattatacataacaacgtatgatataggtataaaagatttggttaatacaatggatgaaacaaaactactgaactacttgaaaggagaatcagatgctgaagagtgtctggaagtagagacatggtaccatgactctgcggaacataaaaaacaacttgagcaactatattatatgctttttgtcggtgagcgcaaagcggtgatggatgcggtggacaccgaaagttcactgagcgctttgaaggatcggatgaagcagaaagagccggatagaaaatcggtgggtaaaatgcgtgtttcaaaatggaagcgttatgcagtacctttggctgcctttttgtgcggtttactgatttctaccggagctttgtattggatgtcttccggcaagtctgccggatatgtttttgctacggaagccggtcaacgggcacgtgctgttttgccggatggcacgaaggtgtggttgaatgcttcaacgcagcttgtttataaaccttctttctggaagcgggaaagattggttgatttgaatggtgaggcttattttgaggtctctcataataagcatagaccctttgttgttaatagtaaagatgtcaggacttgtgtgctcggtacaaaattcaatgtccgggcacgctcgtccgaagcaaaggttgtgacgactttattgaaaggattggtgcaagtgcagctgccgggacagtccgaagaagaagggatcttactgaaaccgggacaaacgttgagtgtggatacccgtacgatgcagttgatgcttaccgaagctgatcgtccgggtgatgtgttgctttggattaacggaaaactgaaattcgaacaagctacactcgtggagattgtgcaatgtctggaaaagcattttgatgtacatttcattatttctgatgcacagttgaaaaaagaacgtttcacctgtacttttagtacggatgatgatatcagacaaattctttctatacttgctcttaccaaacgttttgattataaatgtgaggataataacataatattgactcccaaggcgggtagatagcgatttattattataacctaaatcagtaaaagggactgtttccaatgtggaatggttcctttttttatttctcaatctgtattcttattctttttttgaaaaaagtcgcttcttgatttagtatgcttataggttgaaatgtattattagcagaaaagtgaatatagttaaccctaaaatctgtaacgatgaacaaggacccttaattaaaaaccaaccttaatatgaattagcagttttcttttgctaaacctttcaatttttacctaaaacattttctaattaaaaaagaacaagatgaagaaatcagtgaaacacaagtttcagtacttgctattttttctattgtcgatgcctgcttttatttttgcttcagcgcaagatatccgggtaaatatcgacttcactaaagcccctttaggtaatgtcctggatgaaatcggacatcaaacctcattatctatcgtgtataacaccagggatgttaaccccaatcaaccagtttccgttaaagctactaatgagaatattacgtctgtgatgaatcgtttgcttcgggggacggggatttcctattctattatgaacaaacacctcattctttcagctaatgataaggataaagctattcagcaagagaaagtcacggttacaggaaatgtttcggacgctaaaggcgaaccattgatcggagtaagtatattggtgaaaggaacatccaacgggacaatcaccgatatgaacggacacttttcaatatcggctgccaaaggagatgtcatcgagatatcctatatcggctatgcttcgcaggtcattacagtgacagactctaagccactgaaaattgtgatgcaagaagacacggaagtgcttgacgaggttgttgtaacggctttaggtatcaagcgggcacaaaaggcattgagctacaatgtgcaacaagtgggtggcgatgccatcaatacagtgaaagatgccaatttcattaactctttgcagggcaaagttgccggagtaacgattaacaattccgccggtggtgtcggttcggcctccagggtagtgatgcgaggtactaagtctataacaaaggataacaatgccctttatgtaatcgacggtattccaatgttcaatgtcagttttggcaagagcgaaggttcctttgctactcagagtggttcggacggtgtggccgaccttaatccagatgatattgaaagtattaatatgctgaccggtccttccgcagctgctttatacggcaatgcggctgccaatggagttgtattgattaacacgaaaaagggatctgccgagaagacaactctgacagtcagcaataataccatgttctctgatgcgtatattatgccggagatgcaaaaccggtatggaaataatccgggagaatttgcaagctggggcaataaaaccagacagggttatgatcctgcccgtttctttaataccggagtgaatgtaattaatgccatctctttctcgaccggaacaaagaaaaaccagacttatgcatcggcttcaacaacgaatgcaaccggtatcctgccgaataacagttatagccgttacaacttctcaatccggaatacggctactttcctgaaagataaactgactctggacatcggtgccagttacatcatccagaatgataaaaatataacggcacagggacaatatttcaatccgttgccggcattatatctgtttcctcgtaatgataattttgaggagatccgtatgttcgaacgttatagcgagagccgtggggtgaatgcgcagttctggccttacgggcatcaggggctgagtttgcaaaacccgtactggattatgaaacgcatgaaccgtaaaacagaaaagagacgttacatgatcaatgcaagcctgacttataaacttacggattggctgaacgttgcgggccgtgttaaagtagataattcggatattcgtttgactcaggagcgttatgcatctactttgactacttttgcgggagccaatggtttctattcggaccagaaccgtacagaccgtaatacatatgctgatattatggtaaatattgataagaggataggagatttctcgctgaatgccaatatcggtgcatctattaaagatttggtttacgaacaaatgggtaatgaaggcgatctggccggtatacccaatttctttacagtgagaaatattaattatgaaagtaattataagcccaaacagttcggatatcatgatcagtctcagggggtatttgcgaatatagaattaggttggcgcagcatggcatatctgaccttgaccggacggaacgactgggagtcgcagcttgcctttactaaacactcctctttcttctatccttccatcggcggatctgtcgttctgtcggagatgttccggttgcccgagttcatctcttatgcgaaactgcgtggttcatacagttcggtggcttcgtctttcgaacgttatttatcgaatccgggctttgagttcaatgaacaatcccatcagtggggctcttcaacaactttgcctgccactaatctgaagccggaagacacacgttcgtgggaggtgggtttaaatgccagattatggaaccacttcagtatagatgccacttactatcattcgaatacgtataaccaaacctttaacatcaccctggcgtcgtcgagcggttattcttcggctattgtccagacaggcaatatccagaattatggtttggaactggcattgggatataataatacatggagggatttcagctggaacagcagcctgacttataccatgaatcgtaataaggtgaaacgtctggccagtggcgcgacgaatccgataaccggtgaaatcatcgatatgccggagttgcgtatggctgtgttgggagccgacgggtatggtcccagagtcatcctgagagaaggtggaacgatgggggacctgtatgtagataaggggcttcgtacggatggtaacggaaatatctgggtagatccccagacaggtaaagtcggagtgcaggactatgccgaacctaaaaaaataggtacgatgaatcctgatttcaatatgggattcagtaataccttttcttataaaggcatcagcctgggcgtggttctgaccgcgcgtgtcggtggattatgcgtgtcgaacactcaaggtatacttgattattacggtgtgtccaaagctacagccgatgcacgtgatgccggcggagtgtggatcaataacggattcgtagatgccaagtcttattttcaaaccatcggaggctctaccggaggattgggacaatactacacttatagtgcgacgaacgtacgcctttccgagttgaacctgagttatacattacctcgtaagtggtttaacaataaagtgggcataacggcaggtatcgtaggaaagaatctttggatgatttattgtaaagcaccgttcgatccggaaatgaccccttctactaccagcaatttctatcagggggtagattactttatgcagccgagcacacgtaatattggcttcaatgttaagtttcaattttaaaacaagtcgattatgaaaaataaaatattaaatatggctttggccgcagctatcacgccactcttgtgttgctgtaccagtaattttgaggaatacaacactaatccgtacgaaccccattcacttaatccgcccatgctgtttgcaacaatgattactaccggaatcaatgtacagcagaatgacaatcagatgattgaccagatggtagcgggaccttttagcggctatctgacaatggctaactcatggggtggttctaacttcaatacattcaaccagacggaatcctggaatcagattcctttcaatacgccttttgagaaattctattccaactactttaaattggaaacggcaaccggcggaaaaggtcactattgggcaatggcgaagctgcttcgcgtaaatacaatgttgcgtgtgaccgattgttacggccccattccctacagtcaagtggccaatggcaaaacggctgttgcatacgacagtcaggaagatgtatataaacacatgtttgaagatttggattatgcagtacagatattgggcgaatttgtagacgaggtcggcggattgaagccgttggagggctatgatccggtctataatggagattataataagtggatgcgttttgctaattcgcttaaattgcgtctggctgtccgtatcagtaatgtggcgcccgaacttgcccgtgcgaaagctgaggaagcggtaaagagtgcccgcggactgatagatacgaatgataataatgcatatgtcggtgtaggtgccgaacccaatccgctgtggctggtagcctccagttggggcgaaatccgtatcaatgccactattgccagttatatgaaagggtattccgatcctcgtagcgcagtctatttcacgacatccaagttgggaggcaatagcccgtatatgggtatgcgttcgggattggaaggagtgaagccggccacttatgcaggatactctatgcccaattacgatcagaaagacgatatgttgatgttctgtgcggctgaaacggcctttttgcgtgctgaaggtgctctgcgtggttgggatatgggaggtagtgcccgtgacttctacgaacaaggcgttaaactttcattcgaccagcggaaagtgggtggagcagaagaatatctggcaaatgcagtggcagtgcctgaaccttttgtcgacccgactaacccggttaaatgcaattatacaccgaaaaccaagataacgattgcgtggaatgaaggtgctcctacagaagaaaaactggagcgtatcattactcagaaatggatagccaatttccctctgggctttgaaggttgggccgattatcggcgtacaggttatccggaagtgtttccatctgtcagcaatctgagtaacggagtaattgacaccaaccggcaattgcggcgtttgcctttcccattgtccgagaagcagggaaatgctgccaatgtttcggtagccgtctcaatgttgggggggccggatactggggctaccgacctttggtgggctaaaaagaattgatgtttaagctaaaaagagaaaagaaaatgaaaaagagatatttaaatatagtggtttttgcgttgttcgtcagtatgcttctgggttgcagtgactggaccaaacccgaagcagaggatttttttgaaatgccgggaaatgactactacgagaatctgagagcttataaacgttcggagcattcggttgcgtttggctggtttggaggctggacaggtgtgggagcttcgatggtggggagtctgatgggacttcccgatagtgtggacttcgtttccatctggggaaactggaagaatctggatgaagcccggatgctggataagaaaaaagtgaaagaactgaaaggtacgcgtgcattgatgtgctttatcgtagctaatgtaggcgatcagttgactcccgaagagtataaagagaattataaagaatattggggttggaaagatggagatcaggaagctatcgacggcgcgatcagaaaatatgcaaatgccatttgtgactccatcgataagtatggatatgatggttttgatatcgattatgaacctaattatgggtctcccggaaatttggccagctatcccgaaaatatgctcactttcgtaaaggcgttaggagagagaatcggacccaaatcgggtacggggcgactgcttgtgatcgatggtgagccacaaagcattcatccggaaaccggaccttattttgattacttcatcgtgcaggcatactctaaccttgcgggtaactccgatactaatcttgacaggcggctggccggtacaattgccaattttaaagaggtactcactcccgaaaaagtggctaatatgtacatcgtcacagaaaatttcgaatcctatgctccgacaggaggaggcgattatgtagatcgttacggaaataaaatgcgggcacttgccggaatggcacgctggactccggtcattgatggtaaacaagttcgaaagggcggagtagggacgtatcatatggaatatgattatccgggcgacgttgaatacaaatacttgcgtgaggcaatcagaattatgaatcccgctgtaaaatgacttaaatgaatttgattatgaaaagaataacaataaaatcttatttgcttgcttgtgttgttctgccgatgattctggctggatgcgaagatgccgattaccgtgtgattgacaatgctatttatctgaatgaagcatccgagaatggttcggcaaaggttacggttgatcctgaaaatgttaccacaactactttgaccgtacgcatggggcagcctgttgccggagatgtaactgctgttttgacgattgactcctctattcttaaagagtacaatgaagccaatgaaacttcgtacgaggttcttcctgaacaatatttttcttatgataaagagataaagattcaggcgggtgatgtaagtgccgtaccatcagaatttaaggtgaaaccttattcgaatgaaaacggagaactctatgccattccggtatccctcaccgaaattcaaggaccggtgtctacgatcgggctttcgtcgaagtttattattttactggacaagccgctgatacagtccgtaccgtttatgaatacgacaaatgctgtaaaaccgtccaaagaaggtttgtggggagtgacaaccaacgaatggtcgcttgaagcctgggtacaaatggatggctttgacattaataatcaggctatcttcaattcgggtagcaaagaccatgaggtatatatccgttttggtgacgctatgattccttataattcattgcaggtgaaaacgctgggaagtcaggttaatacggtgactttgtttgagaaagacaaatggtatcatctggcgttcgtctataattcttccggattgttatcgatttatattaacggggtgcttgatgtgactttacaaacgaaaggaggcccggtacggttcgacacgatgaacatggtttcaagcggcagctacttccggaacaattgccagatggctcaggtacgtctttggaagacagcgatcagccagacacaaattcagtctaacatgtattttgccgtgaaacccgctgatccgaacctgataggctactggaaaatggacgagggcaaaggaaatgcttttgccgattgtaccggacacggatacgacctcacggcaggagggacccttgtatggaaagagcatgttcgttttgataaacaataactatgtaaaagaagaataagatatgaatagacatttgaattttgtgaccttaatctgtttgataacaggggttgtatcattggcttcgtgtagtaacgatgatgatgaaatgaacaaatatcaaaaaatatatatcagaacgggagtagcaccgggggctgaaatgagtgctgtagtagtggtagatcgcgtaagtaattcatctaccgctgaccgttctgattttgaaatacaactgtgtgccgtacaacccgtttcacgggaggtcaccgctactttaggtatcgataccctgaaagtaaatgcttataattcggctaaaaagacgaaatgcgagttattgcccggagataattatgacattgagaaaaaagagtctactctgaaaaccggacagactgtggccgagtcttctttccgtgtggttttgaagaacatagagaaattgagcaaccctgacggatacgtactcccggtgatgcttaaagaagttaccggtatggacggacaggctgtaagtacatctatgaatacggtttatatccggatttatgccagcatactctataccggctatacgaagcctgcagactgggcggcagtggaccgcagtgcatgggatgtaagttgcagtaatgcatacgcaaacgatgatgccagatatggtgcacatctggctatcgatggtgaagcaaatacatcttggttttcgtggggagtagccaatgctggagagtgctggtggaatacagtattgccccggcctgttactttggcaggattttcggttagtaaacagagtgcttacggatcgtcatacaatctgaaaagtgcggagatcaaagtcaggaaagacggagcgacagaatgggtgacttatcagaggactttgactttcaggagctttaaaggaaacgagccgcagtatgcagtcatcgaaccacctatcggggatgttaaagagttcaggattgattgtctgagcccggatagctataccggatttgcggaaataaatttatttgtgaagcaatagaggtgtttagattgtagataagggggagaagcatcggggccatggggtttcggtgcttcttttgtgtacttcatcccgacagagcaaaaaaaagaaccggtaaggattagtgattttgtgaagtcagttgtattattatgtagtgaatgcaacttcttgtcgtaattttgggctatgtttttaatatcccctatctttgcttactggaattgttaaccgatggaattattataaaaaactaactgatgaataaaaagccgataagccctgtatgttgggtgcctactgtttattttgcgatgggattgccgtttgtggccctttcgatggtttctgtccttatgttttccgatatggaggtgtcgaatgcacagattgctttctggacttctctcattatgcttccctggacattgaagcctttatggagtccgttcctggagatgtttaagacgaagaagtactttgttgtcgctacagaaatcattaccggactggcatttgcgttggtggcactttcgctgccgttgcccgatttttttcgttatgccatcgctctgatggggatcattgctctcagtggtgcgactcatgacattgcgggtgacggagtatacctgacggagctgactgctacccagcaagccaagtatatcggttggcagggagctttttataatctggccaagatacttgccaacggaggcttggtttggctggcaggtatgctgaaggatgaatttggagtggtacatgcctggatgattgtgatgttgatgtgtgcgggtattatgattttgatcggcctttaccacattcggattctgccttcgggaggaggtgcttccggtgaagtaaatacggtgagagatgcattgaacgtgctttgggaagttattcgttcttttttccaaaaaaaacatattgctttctacattgtctttatcattttgtaccgatttgccgaaggatacgccctgaagattgtaccgttgttcctgaaagcaccggttgcagatggcggattggggcttagtactcaggacatcggattggtatacggtacgttcggagcaggagcatttatcctcggttcgctcttggcgggttattacatctcggcttacggacttcggaagaccttgttttctttgtgctgcgcttttaatattccgtttttggtatacttcctgttggcactttaccaaccctctaacctgttgattatcggtacggccattgtatttgaatatttggggtacggatttggtttcgtcggattaatgctctttatgatgcagcaagtagcccccggcaaacaccagatggcacattatgcttttgccaccggtatcatgaatttaggagtaatgcttccggggatgatgagcggatatctgagcgactggctgggttatcgtgatttctttgtctgggtgctgatcgctaccataccggcttttgtcgtcacttggctggtaccttttacgtatccggacggaaagaagaaataaaagagaatttcaatataaacgagatatatacataatattaatttaatcgaatcatggaagaatttaaaattgcaggtgctgctttgccggccatgccttgggaagaacgtccggcaggatgcaaagatgtagtgtggcgttgttcggcaaatccgattattccgcgcgacttgctccctacttcaaacagtatattcaacagtgccgtagttccgtttaaggatggctatgcaggagtgttccgttgtgatgataccaaccgtcgcatgcgtctgcatgtggggttcagtaaagatgccgttcattgggacatcaacgaagagccgttgaagtttcaatgtgacgatgcagagatcgggaactgggtttatggatatgatcccagggtttgcttcattgaggaccgctattatgtgacttggtgcaacggttatcatggtcctactattggtgttgcttatacctatgactttgtaacgttccatcagctggaaaacgcctttattccttttaaccggaatggagttttgtttcctcgtaagataaacggccgttttgccatgttgagtcgtccgagcgacaatggacatacgcctttcggagatattttttatagtgaatctcccgatatggaattttggggacgccatcgtcatgtaatgtctccggctccgtttgaatacagtgcctggcagtgcaccaagatcggtgcaggacctattccgattgaaacatcagaaggttggttgctgatctatcacggtgtattagcttcatgcaatggttttgtgtatagtttcggttccgcattgcttgaccttgatgaaccctggaaagtgaaattccgttcgggaccttacttgatttcaccccagaaagagtacgaatgcatgggcgatgtgcctaatgtctgcttcccgtgcgcggcgcttcatgattcggagaccggacgaattgccatctattacggatgtgcagatacggtgacgggacttgcattcggatatattccggaaattatagaatttacaaaacgtacaagtatcatctgaatcggataaaagagaaagggtgtagctatcctgccgggatggctacacccttttgtctgtgtggctacaccctttagataaaagggcgtaaccctgtttggagttatccgttgtatgctgtcagcatccaaaccattttttcctgttccttcagatagtcgctcatcatagccactgttacctcatcgttgtgtgaagaggcgagagacaggactttacgctcttctgctatcaggtgcccgtaagtttcaagaatatgattcaacgcgtcatcggctttgctcactccgtccacttccttgatttgtgccatcttcaggtagtcactgtacttattggcgggagttcctcccagcatcaatatgcgttcggctatttcgtccaccttttcggcagctccgttatagaggtcttcgaatttaccgtgcagtacgaagaaaccgtgtcctttgatattccaatgaaatcctcttaagtttgcatagtgaatttgaaaatcggcaagtaattgctgcaatgatactacgatgttgttagctcccttttcatccaaatgtgtataatttaaagttttcataatgctattgtttttttgagttaatactatatatcttctttttatctggaacaaagatacggcacaaaatgattcgtgtcaaactgaaaatttctatctttgcattgatagattctatatctttaataaatcagagaacgatgactatacaacaattggaatatattctggccgtcgatcagttccggcactttgcaaaagctgccgagtattgccgggtgacgcaacctactttgagtgcgatgatccagaagctggaagacgaattgggagtgaagctgttcgaccgcagtatgactccggtctgtcccacttccatcggtaagaaggtgctggaacaggcacgcaaaatcctttcggaaactacctgcgtcaaggagattatcaatgaggaacagcattctttgtccggtacgttccggctggccgtattgcctacgattgcaccttatcttttgcctcgtttttttccgcaactgatggagaaataccccgatcttgatatacgggttatggaaatgaaaacaccggatatccgcaaggctttgctgacgggtgaagcagatgccgctatcattgccagcctgctggatgatgctgcattaacagaggagactttgttttatgagcagttcttcggttacgtttcgaaaaaggaaccattgttcaaacacgatgtgattcgtacgtccgacgtgaccggagagcggctttggcttcttgacgaaggacattgttttcgcgatcagttggtccgtttctgccagatggaagcggtaaaggtcagccaaatggcctatcgcttgggcagtatggagacttttatgcatatggtggagagcggtaagggcattacatttattccggagctggcagtgatgcaactgagcgaagaacagaaggaactggtccgtccgtttgccatcccaaggcccactcgccagattgtcctggttacacgaaaagactttatccgtaccagcctgctgcaagtattgaaagaagagatccaggcagcagtccccaaagagatgcttactttacaggctgttcagtgcctggtataaaaaaaacagcggcgatattttcacaaacatcgccgctttatttcttttatatatcagaattattcttagttttgtcaaatttgtgcaggtgtcttctgttgttttattgagaatgaaatgattttatttttaagttcttatcttcattgatatctattgtgatatactgtatgttgtcataaatcgtgtttacacggagctttattccttttgctgtcggcaacagatcggctatattggccagtttgaaggagacgaggcttgaacccagtttactgggagagtcgtcaaaggcgttatgcctgaattccagacagatatatccgtcgtcttcaacaggacctgtaattttgttttgtaccagattcagcatgtgctttttattctcgtccatactgcccagatattggtattcgatggtgagataatcctttgtaagtgcatgcgccgtgacgttgatgcggtcgtctccaatgctgtccgccgttgcttccgtcagcgggatgatatcctttgtcagtatatcttctatcgtgaatatcttaccgttttcatatccgggcttttcttctccttccatcttcacgtaacccacaaaaaccctctgtccttctgcgacggtgtatttccagttgcgaatatcggccgtatctgcggggaatacgttatttccattgtccagggcaataaaaaaatccctcggggtgtccgcattgggaattttcattgtaccgatggccagtattccacccggaggacaagtgacccaataatcattgtcttcattgtccagacaagactgcaggatgggcattagtgccagaatgagggtaaaagtaactaatttaaatcttctcataagttcctgttggttttagtatcctatttattcattgagatttattcttcgctgtattgaagaaatgcggggagccgtgaaatattgcatcgtaaaatgttaaagaaacaaaagtgataaaagagttgttctctcagtgcagtatttctatctttgctgcatttataaggtaaacacgtgtttaggagaatgaatgaattagagctgtcggaacgttgcaggcagggagataatcgtgcccgcaaagaactttatgagcagtacgcagggcgcatgcttggtgtctgtcttcgttatgccggagacagagacatggcacaggacttggtacacgacggtttcctgaaaattttcgactccttcgacaagtttacctggcggggtgaaggctctcttagagcatggatggagcgtgtaatggtgaatacggctttacagttcttaagaaagaacgatgtgatgaaccaaaccatggcattggatgaagttcccgaaacttatgatgaacccgatgcttcggctgtcgaagcgattcctcagaaagtgctgatgcaatttattaacgaactccccgccggatatcgtaccgtattcaacttatacacctttgaagataagtcgcacaaggaaatcgcacagatgttggggattaatgaaaaatcttcggcttcacaactttttcgggcaaagagtgtattagccaagaaagtaaaggaatggttgatgatcaacggttgacgtatgtcttcggacaccaagtgaacccgggatttctaaaatagaatagaatgatgaaagaaaacgaaaaatggataaaggcattcaaagagaagctcgaggattattccgagccgatacctgcttccggttgggaacgactggaaaaggagctgatgcccgtaaccgaaagacgaatatatccgtaccgccgatgggccgttgccgcggctgccgtagtgttggtggtgacgactgctgtaagtttgtatttcctggatagtccggtcgcagatgaaattcgctatgcgacggctccttcattggctgtcaatccggatatattgccggaaccggctttaccggatgtacaggtcgctgtgtccgagccaatgaagccggcgggagggacagacgtgagttccgcttctgggtatttggcgaaagggaatgatccaaagatcactccggaagcctttccgggggcagagaaacatccggaggctgtggtggcggagaagcctgccgaatcacactctgaagcagctgctgtaacggagaaaaaagagagtactgtgtcacaaatagaaaaaaggaaagaggcccggaggccatccggtaaagacaaataccagttgcccattgagagttcttctgcaaagcggaatggaaaatggtcgatgggagtaggggtaggcaatgggggaggacttccgacgaatggttcggaaagttttgcaccccgtccgatgagcaacagggtagacctgatgacaattatgaatggggtcgtgaatattcccgcagatcaggaagttgtgtttgaagggggagttccttatctgaagtccagtacgactaccgtgatggattatgaacatcatcagccggtaagtttcggattgtccgtacgtaaatcccttccgaaaggtttctccgtagaaaccggattgacttatacgttgttgtcttccgatgtcaagcgacagggagataacaagatgcagactcagaaactgcattatatcggtatcccggtacgcggaaactggaatttcctggaaaagaaatactttacgctttatgtatctgccggtggaatggttgagaaatgcgtatatggaaaactggcgggcgataaggtgaatgtgaaacctctgcaattttctgtagcaggtgcagtaggagctcagttcaatgcaacggagcatgtgggattttatgtggaaccgggagtttcgtatttctttgacgatggttcgaaaatacagactatccgaaaagaaacaccttgtaactttaatttgcaggcaggattgcgattcacttattaaagtaaggcagatgtaagccggagtggcggtggagtttgaacagagtggcggtggcatttaatcggaatgccggtggcacttcattagaatggcggtggctctctggaatgataaaaaagtaaaggggatggggctgtgtcctctgtgttgaaaagactttcgatacactctcatccccttcttaatgataagctaatttacttgtactgtccggaagtattgcctgaataatttttcggccttttctatttgctccggagtgttttctttcactcctttcaagagatattctttgtccatcgcttcgtatttatgaactcctaaagtatgataaggcaatatctctacacgctgaatcatccggtacgttccaagatgttctcccaactgccggatatcgtcttcgaagtcgctgtagccgggcactaatacatagcgcagccagaatggcttttgattggcttcgagccaggcggcggttttcagtgtttgttcgttacttcttccggtcagagactggtggtgttccggattgaactctttgatatccaataaaaccaaatcagtcaaccccaagagttcttcaacatcattgttccacagtccgccgttggtgtcgaggcagatgtgaattccagcttccttcagtcttttaaaaagtgggataagagctttcgcctgaaaagtgggttctccaccggagaaagttattcctcctttcttaccgaaaaaagctttttggctgacagccatgcggacaatttcatccggatgggttggcgtacctcctttggcttcgattgtgtccggattggcacaatacaggcaccggaagttacacccctgaaggaaaacgacgagccggagacccggcccgtcgaatgttcccattgactcgtatgagtgtacgtttatcattcaattacattctttcgtggaaacttcggctgataacttccagctggtgttcgcggctcagcttcacgaagttgacggcatatcctgaaacgcggatagtcagttgtggatacttttcgggatgttccattgcatcctgtagcatttcacggttcagtacgttcacgttcaggtggtgtgcgcctttggtgaagtatccgtccatcatggtcaccaggttgtcgatacgatcctcttgagttgcgcctaatgatttcggaacgatagagaatgtgttactgatgccatcctgtgaatcacggtagcgcaacttagctactgaactgagcgaagcaatcgcaccattcttgtcacgtccgtgcatggggttggcacccggtgcaaaggcgatgcctttggcacgcccgtcgggagtggcacctgttttcttgccatacatcacgttcgaagtgatggtcagcaacgagagggtaggacgggcattcttgtataccgggagtttcttcagttcttcgctgaagaagtataccaggtctacacccaagtggtctacacggtcatcatcgttaccgaagcaggggaaagcgccttcgatatcgaatccttcagtcaggccgatgtcattgcggcgcgctttcacatgcgcatatttgatggcagacagtgaatcgatagcgattgaaagtccggctacaccataagcaaggttaatgcgcggatcagtatctacgaaagccatctgagccttttcgtaataatacttatcgtgcatatagtggatgatgttcatagcctcgttgtatacacgggcgatctgtaccaatacctttttatagttggccattacttcttcgaacttcagcgtttcgcctgtcaatacagggatgtcttttaccatgacagtgcctgtgttttcgcaacgtcctccgttgattgccagcaacaatgcttttgcaaggttggcacgggcaccgaagaactgaatttgctttccgatttcctggtaagaaacacaacaagcgataccgtaatcgtccgattggcggacctcacgcatcaggtcatcgttttcgtactgtacggatgaagtatcgatggatacttgtgcacagaatgccttgaaaccttccggcagttcaggactccatagtacagtcatgttaggttccggtgacggacctaagttgtagagtgtctgtaagaaacggaaagatgttttagtgacctttgtacgcccgtcgttgaaacgtcctccgatggattcggttacccatgtcgggtcacctgcaaaaatatcgttgtacgactgcatacgcaagtgacgtaccatacggagtttgataacgaactggtcgatcaactcctgagcgaatgtttccgtaatagttccctggctcagttcatattccagatagatatcgaggaatgaagacacgttacccaatgacatggcagcaccgtcctgctcttttacagcagccagataagccatgtacacccattgtacggcttcttgtgcggtatatgccgggcggctgagatccagaccgtagtattcacccaacaccttgatttctttcagtgccttgatctgttcggccacctcttcgcggaggcgaatgcgggcttctgtcatcggacctgtaagattatggaggtcctctttcttggcttcgatcagacggtcgagaccataaagggcaaggcggcgatagtcaccgatgatacgtccgcgtgcataattatcaggaagcccggtcaggaatcccaaagaacggaatgaacggatttcatcagtgtatacatcgaatactccgtcgttgtgtgtcttgcggtaatgagtgaagatatcctttactctatcatccacctctactccgttttcacggcaagccttcattactacattgattccgccgaacggtttgatggcacgtttcagtacctgatcggtttgtaatccgacgatcagttcgttctctttatcgatatagccggcagggtgggaggttatagtagatactgtagtgtaatcaagtgcgcgaattccattgttgtttctctcttcttcgagagctttgagacagttgttccagacagccttagtgcgttcagtaggtccttgcaggaaagaagcatccccttcgtaaggagtaatgttgttactgacgaaatctctgacgttaatttctttgctccaaagtccatctttaaaggtcttattcaattccataaaattaatcagttagtggttagttatcctttagagcgtgcaaatttacgatcttttttcggtttagggatataaaaggttcctattttatgttgaatagcataaaaatacctacttatagggaggttgtgttcctctctgttgaagtactctttccaaatattttttgcggaaaaatttgcagatttgaaaatgattcgtacctttgcagcgctttaagagaaaagcactattgaaaagtagttttggagaggtggcagagtggtcgattgcggcggtcttgaaaaccgttgtactgcgaggtacccggggttcgaatccctgtctctccgcaacaaacgctgaaaatcagcagattgcaaaacaaacacccagttttacacccaagaatgtaaagtcggtgtttttgttttatttaagataatacaaccactacataataaaagagtagcgatattaaaagaatccgatgagaaaagactaatatttatctatccattcagtttgatttttcaggactttacatcgtcctgaaagtatttgttattgtattccaacgtcaggagtggattataatacaagttttttgtgtggatagaatttcgttttgcttaatgtacgaaagtacttatctataaacgcatgaaatattagcacaatgaatcattggaaatcaactttggccgtgataggaataggccaactcatatctattttaacaagtacgattgttggcttctccattattttttggattagcaacgaatttaaatccccgacagctttatctctggctattttagctggatttttaccacaatttgtattaggcttgtttgccggggtctatgttgacagatggaatcgaaagaaaacgatgttttattcggacttgttcatcgcgttctgtaccctatgtctttttattgtgataaccaagggttataaagacctttcttttttttatctattgactgcttgtcgttcaataggcagtacgtttcatgcacctgctttacaggcaagcatccctctactggttcccaagcaccatcttgtcagggtatcaggtttgtaccattccattcaatccttcagtgaggtgatagctcccgttgtaggggcaagcctcgttgtttggcttcccatacagtatattctgctcatagatgtgatcggagctgttgctgcttgtctgaccttactttgtgtccagattccttctcttcaaaaaacgaaagttcttccagatttcaaaaaagaactgacggaatgttggcataccttgcggcgtacaatgggcattttgcctttattcgtatgctttacgctggtgacttttgtccttatgcctgtttttacgttatttccttttatgacgcttctgcatttcaacggaaacattttgcaaatgggagttgtggaaatgggttggggctcaggggcattgttgggcggtttagtacttgcctgtaaggctttgaaaagcaagcaaacattagtgatgcatacggcttatgtgatattgggattgtatctgattagcgccagttatttaccatcaagcgcatttataggttttgtttgcctaacatttacaggaggcatagcctattccatttaccatgcgcttttcatcgctattattcagcagaacttggcttcggacatgcttggacggactttttctctcatctttagtttgagtacctttccatcaatgctgggtatcgtagcttcaggatattgggtggaagcatggggtatcacatccgtctttatgatcagcggatgggttatctttctgattggagtgggtgcaaattttatttcttcaatcaagcagttggataattacgcatagtattatttattaaagaattattatatgacaaagaaagaacacactacgattacagagttatttcaagttttggacttgttggaaagcctggacatgcagttttggttggatggaggctggggagtggatgtcttgtacggacagcaaacccgcttgcatagagatattgacattgattttgatgccaattatacagaccaactccttgatcttttgcaggagagaggatatcaaattgaaacaaattggttgcccacccgtgtggaactgtatagcaaagaattaggctatattgatatccatccttttgtcttgaatgcggacggcacttccaaacaagccgacttggatggaggctggtatgaatttcaaccggactattttggaacagcagtctttgaaggcagaagcatcccttgcatttctgcaaaagggcaacaagtattccattcgggctacgatttaagagagaaggatattcacgatttatctataattaaacaatgtataacaacaatgagcctaacaattagataagaacaagaaaatgacagaaaaacaaattgtctggtatatcttacttacagaagtaaagatagacagtgacacccagtctgtcacatccctgagtgtagctccattggcagtcttgccggaattccagcgtaagggaattgggggggggatgttgattcagtaagcccatcagagggcagcacttttgggttacggcacagcagtcgtattggggcataaagagtattatcctcgatttggctatcgcaaggctatcgatttaggaattgaatttcctttcgaagtctctcatgaatattgcatggtggctgaattaatacctggagctactgagaatgtgaaaggtatggtttgttatccaactgattttaaatagtttaacaagtaaaattcattatataactcggactgggtatttcaatttcccagtccgtattctgatagtacttattcaattggaagattgtgttgcttcaagaatgaaagtttatcccaataccctctttgaaagacgattttgttatcttttacatgaaaaaatccgcatccacgaagtccaagagagtctttccattccatgatagcccattcgccatcttcaaaaatattttccaccatacaaaccattttagcagtggcaaattcattcacaaacattttgtagattgattctttacctattattggttcgtttgcgacttgatgatttactgcattagtagcatacagctctgctatatgataagcatctgctttgttaaagcaatctatccatttttccaaaacttctttaggcttcattttttataaattcttaggattttgattctgtaataaaaacaatctgtttggatgcatagatacttgattttattaataataggctattctatattctaaatcctctggatttttgctctctctgcaccgagttacgtagattctgctgtaacttttcccattgttccttaaaccattgtactatgggttgtcggtttatggtcagcataagcttaccactatccatcggatgtttctcaaccctaaaaatatcattcttgatgtcaaatttccacctgtgttcttcggaataaattttgccactacattgtatggattctttctttgtcaagaggttttctatcatgtctttggtaaacccgataacagcgcataatttttccattctcaacatctctttgaacatgggaaaccatttgtgggctttttcaagcaaggtgctcaatcgtgatatttccttgtctttggcttcaagttcttgattatgtattctttgaagattacgaatttgtctgctatgctgttcctgtatttgttgtatctgaatttttaattcatcagtagctttgtcccgtttggtaatttcctgatgtagctgctcgatgtgatgttccagttctttcagcttaccgcttccgaaaagagaacctacaccgcttgctatggcggtagcagcattggtggctgttttctttagtttgtccgtgcgtatctctgcttttacctgtttgagttcctgttcggcaaggcttacttgttgttccttgtgtcgcttggtttcctctatacgttgcagttcggctttctgcttctcaatgatgaaatcatttcgttccagatgctctttacctgtgacagcttttgcctgtccacgttccatcaggagaatatcggaagcaagggtctgcatggttgccatatcctcgtcattgagctttcggctctttccagtttcatggttcatccagtcgaatacgacatgagcatgataatttggtttgaaccatctgttaccgacttggaagctctccttgtcttctgcttccggctgaccgttcagccaatgcccttcgtctttatgcaggaaaatctgtagcggagtgatgccccagcgtctttggcactcttcaccgaatttgcgtacatcagccagtgtggtgtccggtctgataagcaatactccttcacggatgggtgagcatcccgccaccttgataatctttccattctttcccttgcgttccctttccttttcctgcatggcacgtccggtcttttccttgaccatttgcttgatattgtcataatgagttcgcagttcgggagtgccgaagtcgggatttatccactgttcgttatcggtggaaagttcgggaacgacatagattctggactccccgatattacgcatatactcggcagtccttcggttgtgtgcctcgctcgatgcgatgttgcaaggcttgatatgtatgcttgattttgttgccatagcttctttcctttgtttacaattgatttactttgctcgctttcgcagaggggttcttaggggtaacccataagcggagattgcaaagagagggtcactctttgctcggggttctcaggggtgaaacgccctgagtgggtcattagggcaaagccctaatcccctcgggagagcccacaactacgaaagcgaagcgtgtagttatagtgggctataaccggaagcctttcggtttcttggatagcgtatcattcctcttttcgacagattgcgcttgctctttcctatcggctattcgtttctgtaaatattcgttcagatctttacatccactgtagatttgcgaggcgtcacgtatataccgggtagcatcatactcctttcggatttgctgtattgcttccattcctgcacggtcattgtcaaagaaacagtggatgcgctcatagcttcccaacggatagagtgccttgggaacattggctacggaattaagaactatgtaatcctgtctgtcgaagtcgggtgattgcggacagctttccagccttaaagtaagaaaggaaaggtaatccataaatccctcaaaaacgtaacatgtactccttggttttcctgactgtctgatatgggatatttcttttggtgcgatacatcccttgaaatatcggttgcgaatttcatatccgcctgatatgttcggaaaggcaatggcgaaataccgtttgccgttgtgggtgaaacgggcttccttacattctcttttcgccagtgccgtgtttatccctctttcctgtaggtaggcaagcagggcaggagaagccagcagcacaatgtccaattgctgaaaactcggttcggaaaatgattgcttgccaaaagagaaagacacgggacgtatgtgtggtatctgttcttcgattttctgtagaagataaggcacatagtcggaacagtagagttcctgtgccagtgcgatgatatttccacctttgccgattgcgaaatcataccattggttgcgctcggtatttactttgaacgagggttctgtctcttcccgtaacggggatttgtaccataggttaataccttgctgcttgacgggagaatatcccaaactgtacagaaaatccgctatcctgatttgttttgctgtctgtatatccataataagatgagtgtttgaataatggttggaatatttatttctcttttcgcccgtacttttttatgaagtacggtctgtataatcacttcactttatcttcgtatatataggatacggtaataaagtgaagcgcttttctattccctacaaccgcttcgctttattcttaatatatagacctgccgaataaagtgaagtgattacaggttatacggtctaatagtgaaagtccggcttgaacgtgtatttcctgccgttctcctgtactatcatccgtttgttccggagcatggtgataagtgataccgctttttgatggttcagttttacacctaccgacatatatgacttgattaaggaggtttccagatccttgtagccgtattcctctttcagtccgaaagccgcttccagtgctatgcggtgctgctgttcgctaatatgtctgtaagggtcaaacttttcctcttccggtcttccgggtttcttcgcttcgggtctgtacccctctatgagttcaggcaatgcattgtcgttgatacggaaagcgaaaggctcgaaatccattgcacggatgtgcatggctgaaacattgcttatatccccgttgctcttgtccttttccaccagcagaacggtttccgccttgttgttcagctccgtaccgatatgccctcttgcgttttcatcgcctttgttctggtggagtatcgtatggatgtgtatctgcctgtcatccgtccactgcatcagtttggatataatgcgtgtcgattctcccggactgttgatgtcatataccatatcacggatgccgtctatgattacaagccctatgtccggtgtattatagatagcctgttcgacaatcctgatacgctgttcgggcgtgtatttcctcaaagcgagaaactccagatgttcattgtccctgtcatcaggaagaccagcaagccgtaaaatacgtttcatgactttcagacagtgataatggctttgttccgtgtccacataaagaatcttccttttttcttccggtagttccgcaacataccgcagtaccgtaccgtttttcaatgcggcggctacgatagccgatacattgaaagtctttttactcttggctttgccgatggatgcactgaaattgcccagtgtaccaatgaccgaaccttgcacttttagaatctcaggtgctttttcgtagattttcgacagactcaggcgtgaagcttgccaaaggattattgcctgttctgccgaaatctcctttatttctttcatatagtccataagcatacctcccattatttccgtcctcctgttttcttcccggcaagctcaagagccaattccgcatctacgataatcttgcgccctatctgggtaatcgccttgtctatcttaccgcttttctttatgcggttggcagtgggcagactgcacccgaacagtttggctataccgagtattccgtacacatacttcttttccgtgtctgtaacgggttgcggcaatgcttcggcctgacctgaagcgtgcttactcaggaatatgaattcttcgcctgtcatctgccagacgggttttgataataattcttggatatttgtcatcgtccaatctatttagtcgttaaacaatcagccctgcgcactggctgttatttctgttctcgaacgatgcaaaattaggtagggttatgagtggtaaggatggggacggtacaaactgaatatcattgtatcttattgaatatcagaaaataaaaataccactcaaaaattattttgagtggtaaaagtggaactttcgtaaagtatcaggatatattacggattatctgaatatatgttccatttccttggcgaaattttggttgctgtcactggggaaatctgaaacaggctccttgtacttggatttgtagtagctgtcgtcaatatccagcagtttcagtattctgtctttccatttgtccctgtcctgtttggagagtttctcgctcatcaggaatatcagatagcatacacgtattttctctctcggttttattttcagcttacagttgcaggggtgaagattcatattggcatagaaatccagtgcggaaatttcttcgaactgttctcctatgcacacctcatgaatgagcgaaagtaatttcatgctgaaatattcctgttgttcttctgtcgtttcctgctgactgattggctcgcttgatttattctcttgctttccgtcaggaatgtatttcttcaatatatccagaaaaaggcagctttgacggtatatgtccgcacaacagttcttcatgtattggaatgcctctgttcttgcagccttttgctgatcatagagtttgttcagtttggctttttccctgtcatattcagccttgcagcgttcatattctttctctgcctgtttttcctcttcggctgtatgctccctgtaaccaatggaatcatacctgttgttggcttcattcagcggcttgctcagacttcttgtaacatccagctgggcttcaatttcctgagaatacctttccatgtgctgatagcaagcacgttctatggctctgtcacttaacgggcgtatctcataagcctgtatgctcttttctatttcagttttcaggctgttgagtatcaaggtgtattgctctttttgcttgtcaagcaccagttcaaggatagcggcttcaaaggatttcatgtcattatactcctgatagaaatccgatatgaatttctgcctgtcaaaagaaaaagcgtaattatctatatagtctctgtatattctgttgagttctccatattggggaatcatcgtctgtatctttcctgccatatactttatattatgggttcttgtccttgtcaaggaataaggtcagttcttcttccacttcttctatactcggtagggcagatttcagattttcgggtactgccttgctcaattgatagtcgctgatacctatcggctggtcatatccagccaaggcatattgtgccacgacctcatccttacccctgcacagcaaaagaccgatggtcttgttatcattttctcccctcagtttatcatctacaacattgatatagaaatttaactgccctgcatattccggtttgaatggcgttgctttcaattccacgacaacataggcatggagcttgatattatataggatcaggtcggcgaaaaagtcactgtccccaatctggaaatgtttttgtctggcaacaaaagcaaagccgttacccatttccagcaagtaacgggttacatgctttaccaactgttcttctatatccctttcgtcagccttttcctttgctcctgccaagtcaaagatatacgggtcttttaacagataattggcaagatcgctttgaggtgccggaagtgtggcagtgaagttgtttaccttgttactcttgatttgtctgtcatacagattactttcaatctgcattttcagcacattactgctccaacccatttctacagattgtttcatataccaataccttacgcccaatggtagcggattattgagtatgaccatatggcttgcccaatttattcttgcaatcggtgacgccaagaataaatcttctatatcctctatttttattttatagatggttgctactgtttttgctacattctgaaattgcgcaggaacctcctgcgtaatttctaaagattgattatcagctgattgtatttgcgcagtaagctcctgcgtaaattgtccgctattgagcttaaggacttcattagtaatgttttgaatatttgggaccgacagtattgaatctgcttcaataaaactacgaagtacatttaacggatataaacgggcaaactggcacatataagtaagattacgttccgaatatcccttcttttcaggataattgaatctgattgcctgtgccaattttttgataattttaccaccccacccatgtaggtgttggtggtacagtatataattccccattttccagtaatggaacaacatctgggcattggctgcggtaatgagtcggacttgtgcctgttctatttccgaaccgacagcatggacaaaggcatcaaaatgacctttctttatattatgttcgttgttattttccatatcactaactattacttaacaaagataactctaataatggataatctgtgaaactgactgatacttttagagttggttaaacttgttcattgcattggccttaatatcgtctgctatgtcaatgtaaggcttcatggctttataatcactgtgccctgtccatttcattacaacctgtgcaggaataccgagagccagtgcattacagatgaatgtccttcttcctgcatgtgtgctgagtaatgcgtatttcggtgtaacttcatctatacgttcatttcctttgtagtaggtttcacgtataggttcgttaatttctgccagttctcccagttctttcagataatcattcattttctgattgctgataacaggcaatgccatgtggttttcaaaatggatgtccttgtatttttcaagtatggctttactgtacttgttcagttcaatactcagactatctgccgttttaacggtggtgacttctatatggtcggacttgacatcacttctctttaggttacgaacatctgaataacgcagactggtaaagcaacagaacaggaaaacatcccggacacgttccagatactgtttgtctttgggtatctgatagtcttttagtctgttcaactcttcccatgtcaggaagattaccttcttgggggtggttttcaatttcggtttgaacgtatcgtatgctatattctggtgatagtctttcttgaagctccatcgcaggaaccatttgaggaatcccatttgtttaccgatggtactgtttctcatgtcttttttgtcacgcaggaaattgatatactcgttcaatccgaactcatcgaaatattcaaaggtcacatcttccttgaactccttgaggtgatttttaacggctgcaaacttttcgtatgtggattcagtccagttattctgattgccgcattcttttacaaattcatcgaacacctcccaaaaacttatctgtgcttcttcctgctgttcttcgttggcattcttcatccgcaggttgaatgcatcctttagttgttgggtagttggcatggtttcctgtacctcaaactccttgaacacattttgaatttcggcatagtatttcagcagatcggcattgatttcagatgcactttgctttaatttgttggtacacccgttctttactcgctgcttgtcggaatcccatttggctacatcgatgcggtaacccgttgtaaactcaatgcgctggcttgcgtatatgacgcgcatacggatggggacattctccacaattggcacaccgttctttttccggctttccaatgcaaaaatgatgtttcgtttgatattcataattgggtgcgtttgaaattctacacccaaatatacacccaatatttggaatagcaaaagatattcagaaagatttagatttactatgtattccaaattgtgtgtgattatcagtaatttgcaattttatgatatttcttgaatgtataggttcgagagcctgtctctccgctgaacttactggacagaaatggtcagtaaatggacaaaaagctacaaatcaatgatttgtggctttttttattgcccgaaagtcctgcttccaagacttcaaaagtacggtaaaagacaaagtttcgttactaaatcgttacctattccctgccggacaaaaacggtaacgatttgtcctcaaatgacctgataatgacttgattagtccatagtctgcataactcgaaaacgagaggtaaaaattaattttgcaactaaaaaaagtgagttatgaaatcgacattcaaggttcttttttatttgaagaaaggttctgaaaagaaaaacggcgaggttatgattatggcacgcatcaccatagacggcaaactttgccagttcagtacgaaacagagcatccagcccgacaactggaacacggctgcgggcaaagccaaaggcagggatgccgggaggataaacgcccttttggacgacatacgttcttccctgaacaccatttaccacgaaatgcagcggcgtgacaactatgtgaccgccgagaaagtgaagaacgagtttttgggacacagcgaaagccacgaaacaatccttaccctgttccaaaagcacaatgacgatgtgaagcagcttgtgggcatatccaagacgatagcgacctaccgcaagtatgaagtcacacgccgacaccttgcagaatttatccgcagcaagtacaacgtatcggacatatccattaaggagattacccctatgttcattaccgattttgagttgtatttgcgtacagcctgcaagtgcggctacaacaccaccgccaagttcatgcagttcttcaagcgcatcatcatcattgcccgcaacaacggcatactggtgggcgacccgttcgccagctacaaaatccggctggagaaagtggacagggggtatctgacagaggacgagataaaaatcatccttaaaaagaaaatggtttccgagcggctggaacacgtcagggacttgttcatctttgcctgcttcaccgggcttgcctatatagatgtagccgggcttacgcaagataatatatgcaaatcctttgacggcaacctttggataatgacaaagcggcaaaagaccaacacggacgttaatgttcccctgctggatattcccaagatgattttgaagaagtacaagggcaagttgccgaacggcaagatacttcccgtaatcagcaatcagaaactaaatgcgtacctgaaagagattgccgatgtatgcggcattaaaaagaatctgacatttcaccttgcgcggcacacgttcgcgacgactaccacgttgtcaaagggcgtacctattgaaacggtgtccaagatgctgggacacaccaatatcgaaacgacccaaatttacgcccgcatcaccaacagcaagataggcagcgatatgcaagggcttgacaagaagtttgtcggcatcgagaagatttacaaggaagtcgccatgtaaattttcagttacctatataccgttggtaacaaaacaggtaacgattttggtaacgaaataccacctaataagctatatccgagtattttacattctttcaccttgcgggcagtccaccgactacccgcattttttattcccttttccactggcacattccacgaaacgccagccgtgcgtggcatggctgactgattttcgtgaaaagagccgttggaaacccgcacaagcgtaccgcaagatgaacttgccatacccttgcctttcccgcccgcatggagtgttccctaaaggatgaaagggaacaagcacttttcccctgtttccctatctgtaaatcttcctcattatgcagtcccccagccgggacagtcgtttttatcatttcaataggcaaaggtagctacgggggcttttggctctgcaaattgggtttcatcgaaaaaaattgttccagcttcccgttggtcggaaaaaatttttgtcggaaaaatttgcatagcaagaccccttcaccaaccagcctatgtgaaacgaaaacgaccgacccgaccggaagacgcataaaaaaaaagtcggatttacgggaaacaggaaaaaagttcagtgaaacttcaactccctcacctctcaaatccgcataaaatcaaaaacttaaaaattacagcaatatggaagcaaaggtattatcggaagcaaaagtttatgtaggcacttacgccaagtacaacaacggttcattgtttggggcatggctcgacctttcggactattcggacaaggaagaattttacgaagcctgccgggaacttcacaaggacgaggaagatgcggaatatatgtttcaagactgggagaacgtgccggagggcttaatcggcgaaagctggatttctgaaaacttcttttccttgcgtgatgcggtagaggatttggacgacaccgagcaggaagcctttttcgtgtggtgcaactacaaaagctatgatttgagcgaggaagatgcggacgaccttataagggactttcaagacgagtatcagggacaatatgatgatgaagaagatttcgcctatgaaatcatagaggaatgctacaacctgccggagttcgcaaagacctatttcgattatgaaaagttcgcccgtgacctgtttatgtgcgattactggtttgatgacggttttgtgttccgtgcggcataatcaaataccaatccgggcggggtgtcaaagccctgcccgttaaaaacaaccaagcgatgaaacggaaaagcatttataaaatcttttggcgggtattcctgctctgccttgtatggcggttcaccagcgtagccggagcaggcacggcgataacggcgtatatcgtatttcgtgccgcctgtttcctgctccgtgtctgcctttcagccctttatgcgctgggcgtggctctgcttttcctatcgttgcttttcttactgatattataaccataaaaaaatagaacatcatgcagtcacttaacaaaaacggggtaagcattacccaaacaccgggagcagaaaaatacgtcaaatgctgtttaggggctttcaggggacagatttattttcaatatgactaccgccacacggacggcgaacttttcagcacagtagccaaaacgctggacgagtgccgccgcaggcgtgacgagtggatagcgaaaaagtaacagagtaataagtaattttagggatatgaaaacgacagaagtaaacaaggagcttatcggcaagcgttgcgagtgtatttttacgggcttaatggtaacgggcgttatcgagggcatccaagacgaccagcattccacagcggtcaaagtccgtttcgaccatccgcaccagtggggcgatgatttgtataatgatgtgtgggcgtgggggcgcaaaattgacgagttcggcacgctgcaccatttgcaactgttggaggacaaaccggactttcagataatgacggtagttttcggcgagccaatcagccggatagaccgcagtgtttttgaagatgtggacacgtggggcgtctgttccctgcaaggctgggtaaacagctacgagagtgtccggtttgtagccatagacgaccatacggcaattatcacgggcgaatacaacatggaacaggtaaaggtgtggttagagaaatacacgtccataaagagccttaaaaccagttgatagagaacggcggctgtttgccgccgccactttctttcgtgagtgccgggaaataaagtggcaaagaaacccgccctgttccctaacatgaaaagtccacccgccgaactgtcagcgggtggactaccataacatacgcattgcgtatcattccctatttggtgtcccctgtctatcgttgcttttcacgtatatatgcaaccgataaggaaataaaacctataaatcttcatgttggaagaattttacaccaagtatgcacacggtttcttcttcctcgttgtcgtatttccatgttcgtttatagacaagcatttccgtgtcgcagtcgaaccattccattacaggcgcatcatcttcttcgtccgcccatttgaaaacctgattggacggcgttttccacaattcagccctgtcacgtgcggaaatgcagtccttatccacgataatgatgtcacctactgccggaactgtatctgtttccaacgtggtttctatgtaccacgagataccttttatatccaattctatttttaccatgtcattttattgtttagggggcgttattgtttccgtttcgtccttgccgttgtcattattgaacgatagcgaaagttgctgcacctgtccaaagctatcaatcacataaatgtctatcgtctgctggtctgtcgatgccgatttgtagtagagccggaacgtttctttctccagtgggtacaggtcattgggcaggaacaccgtaccgttatccatttccagcttccctttgccgtccggctggaagtacctgatttgataggtagtcggctggtaatagccgccacgcaccagttggcagcgtatttcggcggtttccccgactttcagccttttgggtactggcatcgtttcgatgctgaacgggtacgcctgctgaatatccaagttgtcattacaggcggtgacaagcacgagggcggccacgatgtagcagcccatgatgattttatacattacattcttcatatacattatcatataagggttatcaaaataaagtagtcgtttgcctaatccgggcggcaacttccctgacaacaggaacacttaccgcatttccgagcaaggcataacggtgtatcttcgctatctcttttttctctccgtcatatatcccgtatcgggtatagttatcgggaaagccttgcagcctttcgcactctacttcggtcagcatccgcacgtgcttcagttgttcgggtgtaggcgttccgttgtacgcttcacccgatttcaggcacagcacgtagttcccgatgttaggttgcctgccgtagttccttgttatcgtaccacttggacgagcagcgggttcatcacccccgaccttaccatgcactccgcccggcgtagggagaggaaataggtctgcggtacatctgtctgcaacacgtccgacaaggtacatccgctcccggttttggggtagaaaccatgccgtattacacagttgccattcaagtctataaccgccaatgtcggcaaacgctttgacaatgctccaaaaatccgggcgatgtcttgcgaagaatatccctttaacattctcccagataaaaacgtcaggtctgaaacgcctaacggcttcgactgcatatctgacaaggtggctttctcccccttgcagtccctttccgtccccgattgcgctaaaattttggcaagggcttccgaaagtgacaatgtggggacgttcgatgccgacttccccgatgtttgtaaccgttccgatgtgttccgcataaggaaaattgtatttgaagttagcgattgcgtgtttgtctatctctgaaaaatataccttgtcgaaagtatatccggcggcttccagccctttgctgaaaccgccgatacctgaaaataattcaagcagtaccataggctaattgataatgaatttcagtcccacagatacctgcgtgtggaacttgccgatgtccgagccgaacaacgcccgttcccttgcgttcagtagcagagccacccggtcggtcaggtaggcttccagttccagcgtcagcgcaccgccgtaaatgaagcagtccttatccagcaaagtagagccgtccggcaacagcttttcgcttcggttgcttgtttcatacccggcgagtgccgacagtcccagcgaaaggaaaaaagtctttcgcctgtccgataggaatttcaggtaatagccgccctctgcggtgaactgttctacgggtatctgcatatccttgtagtcatacttcttgtgcaggtattccccgccaatcacccagcggttggcgttcttggtgtaaacgctgtatgccgccccgatatggtaggcgaaatccgtgttgtcgttccaatgcaccccgtccgccatgcccgccgtgacctgcaagcctttcatgcccggcaggtatctttgtgcgtgtgcctgaaacgaggtctggcacagcgcaaagagcatcattataaagatgtgtcttttcattccctacttgatttttagttcgttaatcacttctgcgttcacgatgtcggcgttctccacccggataacctgatgccgcccgccgttcttctcgtagagttccaccaacagcagcttgtcgtcaggaatggtgaacttcggcagggcgtacaccgtgcgcacggtcgttttcccggcaatctctatcacctcgttgtaactgcgtaccgcatccagcaccgtttcctgaatagccgtgcgcttgggtactttcttatcggttatcttaaacttgatgaagtcggtatcgaaaggcacgttggaactgttcttcgtctgcgtgtgtacgtagagcatcccgttataggtataaatgcccttgattaagaactgtatgccgaaacgcttgctacccaagtggcgcactttccggtcgttgttcttgtagatgctccgcattatcagtttcaccagcagcgggctttcattacccagttcccggaaatagatgttcatgcgggtatgtgagaagtcggacgtatcttcattctccaagaagtctttcatttcgatgttgagcatttccggttcacgggcgtacttggcgttgaatgaaaagaaactcccgtcctcgcagataacggagaagttcgtttcgcccggaaagccctctgtcgtggctttcacacgtattacgttctccgcaccgtccgcctttcccgctatgatgtggttgcttcccaaatccacgtagcggacggcggcggggaagatgatatgcaccgtcttggcaaaggtcacttccacgccgtagggcgtgaccatttggcggtacgggagtttccgggtgataccccggtacaagtcgttgccagccgcatacttcacggagtcagtggtttgtgcgtttgccgcacacacgcccagcaagagggcgaacattacaaaaaactgtttcatcgttaattgaaattttagtggttaaaaattattgttgtttggcatacagcatgactttatagcctgctttcagctttacttttactgtcctgaactttttcgcaagataaccggacgtaccttgcaacaagccccttgtcacatccatagccacctgctgcccggcactccgtgcaaaggaaatgcttgtacccagtccgctgccgatattcgccatagcttcgttgaacgcttcctgctccatagaggacggcacagataatcccttttgcccgtccgtgtcgaacacggcgagttccaccgggatgatgttgccagcgtactcaatcgaggacaccagtatgtcgagcctttcaccctgcacctttgccgttcccgccacaagggtattcttcggcacgactatgtttcccgcctgcatgggttcgagcagccgtagtttcaccgcctgcccgtccgtcagcgtttggtcttggtggatgcaggcggctaccgtgttcctgcccatagcgtagcccgtgcctaccgctgtgttgaagccgtagtttcgtggctggctgtaagcccggatgaagtcggcatcgctcatgggctgctgcaatcccgatacggttgtttcccggattgcctgcacgggctgggcttgcggcttttgggtgacagtcccggcaacaggcacttgtgccgtttgcccgttctgcccgccctcattcatgtactttgccgccagctcgtaggatttttccaagagtgccatttggtcgtcagcggtaggcgtggcgtgctgctgttgttgcagtctgtcggtcagttccgccacctgccgcttcaagtcctctttttccttgtccacagggggcgtttcgtagaacgtgcttaattggcggttgatgtcccggtaagcgtttgccgaataagaagcaccgccgcccctttgtggcttcggatcttcttccggcatcaggtcgatttccgcttgcggttcttccgtttcatcgtcccccgtgaaaccgaagtcctgcaaggattgtatcttgtcctgctgcttgcggttcagcatcgcctgctcgtaagccttttgcttgtcggctataatcccgtcctctgcgggcagggggatgtcggcgttgaagccgcccacgctttccacattcacgtcctctttgccggagggggcgaatatcaggtacatgcacccggcaaaggcaaggaacatcagcgggaagactatcatcttcctgcgctgctgtacctgttggggtgtcagttcccgtttgggcttatcttcctttttcggcttcccgtccgcctgcggtacggtagtgccgttctcattcttctgtatttcttccatattgtggtctgtttaacgggttgatactgtcgctatcgtgtagcgggtattgtttgatgtgttctatttgcaagcgttgtccgtcccgtttccccatattgtagattgatgaaacggtgatgtagatagacaagccgccgaaaaagaggaacatcacgaggataaccgccagccttttgcccggcgtaatccgtccgcacatttggcgcaggcggtcgtccgcccagtcctgcaccctttcgatgtaattttgttttctttccataaggctacctcttaatagtttgcaaatccttgttctcggtaatggtaaacgcttcgatgatgaagccgtgcgggttgttgtcgctccgtgtggcgttgagcaggcggcacgaggtcacaaggctgcgcaccgtcaggctgctttcccggacaatcaactggcgggcatacgtgttcaccttgtaggggtactggtcgaagtcgcacttcacgctgtcaatctccaccgtctgcgtgacgtttccggaaatcacccggttgtagtagcccttttccgccaagtccttgtaatagttgaaagcggtcttgtcggcgaggaacagcgagcgtttgatgttgctttcgatagcccccttgtcgggcgagagcgtgaagaaaagctcatggaaacgccgcacgtgcgatttggcttccacgggtctgttctgtgccatgtcctgcgagagtgccagcatcaggctttttccgttgtcgaggacgtatatcttctgccgctgtttttcggcgaagctgtacgagttccacacggcaaagcccgtcaccagtgcgcacaggcagatgaataccagcgcaaagagccggatttgccggaaactcgtttcgatgttcgttaatgatttaaattccatatactaaattttgatgttggttatttgagtagtttcccggttactttcccgcttgccgcaccgaccgcagccccggcgattgacccagcccgtgctacgttgcggttataggcggacgtgccgccagccgacactatccagcttgccaccgttggaatggtgaagtagcccacgatgccgataatcataaagattacatacacggtgctgctcccgtcaggaatgaaattcgggtctgaaagttcctgaatgtccttttggagcatcagcgtttgtatgcgtgccagcacgctgctgaacaaatccgacacgggcaaccacaggtaaatggagatatagcgtgaaatccactgggtcagcgtgctttggaaaccgtcatagacggaaatcgcaaacgccagcggacccagtatcgaaagcacaatcaggaagaacgtgcgcagcgtgtctataatcagccccgccgcttgaaagagcatttccagtaactccctgaaccagtcccgtacggacttcttgatattgtaagccgccctgtccatgtacatccccgtcatagtcaccatgtcggagggcgaccagcccagttcttccagttgcctgtcaaattcctcgtccgatgcgaggtaagccgtttcggggcttcgcatcagggcttcatattccagtcggtctttctgtgcccggtactcgttcatgtcgaaagtctgcgtttccataagctgattgcaccctttcaccactggcgacagcaccgtgttgattgtccccagcacgaacgtgggaaagaacatgatgcacagccccagcgcaaaggggcgcaggagcgggtacacgtctatgggttcggcacgtgcgagcgactgccacacttttgccgccacgtagaacaaagctcccagcccggctatccctttcgctacccccgtcatgttgctgcacaagggcatcatttcatcgtacagcacccgcaacacttggtgcaggttgtcaaaatccactgctgctaataacataggtataccgatttatatgttaccagtagcgttcatccgccgagccgtagagagccagcacccggtcggtgtcgttcttcttctttgcccgcaggtaggacacggatatgttcttgcgggtgtagtagttcacgaggttacggtaattcaataggcttcggtaggcattatcaataatagccagccgttcggcatccgtcagcgacatacccgtgatgttcactacattcttcaagtcctgcaacacgtccgagctttccgacatcagtttggcatagccgaacgagattgccgacagttcgtcaggcgtgaaattcgggtctgccagcatactttggaagttgcgcacgtagatttcggatatttccgccaccagttcaatggacttcttcaccttgacaccgcccttgaccacgtcatgcaccgctttgagcgcatcgtaatattttttaccctgctggaaaatcttctgcgcttccatgaagccgtccagcgtgttcttggctgtggtggaagtctgcactatctgcttggtggtgttgatgataccctgtgccaagttgccggggtctgacaccacccactgggcggatgccttgccgaggaagcaaaggcataccgccataaggagaattgttttcttcatgttcctgatttttaagttgttgatgattggggattgcgtttgctttccgcaagccgcttgatagccagttcaaggttgccgcccagcttctctgcgagggcgaacagttccattttctcgctttcctctgtcgtgaacgtgtaatattcttccaacgaaacttccgtggcatataccgccgactgcgtgccgcccagcgagaagaaaacttccttgtacttccgtccggggtggttcgccatgttgatagacaatatctgcgaacgctccttgtcggtcagtccgagcaggttttgtatgctgttgaacttgttgagatattttcgctggtctaacaggattttacagtccgagttgttgatgatactctctttcactatgggagaggaaataatatcttccacttcctgcgttaccacaatcgcttccccgaaatacttcctgacggttttgtacagatattttatgtagtccgccatgttcgccgatgcaatcgctttccacgcttcctcgattagtattaacttccttattccctttaacttgcgcatcttgttgatgaacgcttccatgatgatgatagtcgttatcgggaacaaaatcttgtggtctttgatgttgtccaactcaaagacaatgaagcgtttatgtagcaaatccagttccttgtcggagttcagtaggtaatcgtactcaccgccacgatagtacggttcaagcacgttcaggaaattgtcaatgtcaaaatccttttccctgacgttcttctgttcaagctgtcggcggtaatcatcccgcacaaactcgtaaaacgtgttgaagcagggcgttaccgacctgtcgcccgtgatacgttcaatataggcacttaccgcatttgacaacgccacttcttccgaccgcttcggggcttcatcgtcccgcttccacagggtgaggataagggtttttatactctctttcttctcgatgtcaaataccccgtcctcgacatagaacgggttgaacgctatcgggttctcgttggtgtaggtgaaataaatcccgtcctcgccgtgcgtgcggttgtggataagctgggacagtcccaagtaactgttacccgtatcgaccagcagcacgtgcgcaccctgctcgtaatactggcgcaccatgtggttggtgaagaaagactttcccgacccgctcggcccaagtatgaacttgttgcggttggtggtgatgcctttcttcatgggcaaatccgatatgtcgatgtgcagcgggcgaccgctcaccctgtccaccattttgataccgaacggggaaagcgaactcttgtagttcgtttcttccacgaacaggcagagagcctgccccaagaacgtgtagaaactttcctctgccgggaagtcggcttcgttgccgggtatgcccgcccaaaagagcgtgggcgtatcgaccgtgttgtgccggggcttgcactccattagcgcaagctggcttcccacatcgttgcgtatgcgtttgagttcgttccggtcgtcactccatgccatgacgttgcagtggcaacgtaccgagataagccccttgctgtgggcttcgttcaggtactcgtctatccactccttgttcacttggttggcacgggagtagcgggagagcgattgcatattccgggcggtctgctcgaagttcttcaggttttcggcgtggtcgtctatgaagatgaactggttatagacgtggttacacgacaacagcacgcccaccggggcggcgaatgacagtcggcagtcgctccggtcagtggacagcttttcaaaccgtgtgtccgtcccgacctttccgggcaaatcttccacgtccgaaagcgtgtgcaggcacagtatatcgtccccgatacgcatttcttccgggtacagcccgatatcttttaggcaagtagtgtcggtttgcgatagcgagaagtatttctcgatgatgcccgcctttccgtcctgcccggtgatttccgatgccgccagccgggtaagcgtgacaaaaccgctgtcgttcataatcctttcaaactgcccgaccgcttcgatgaactttgccgccgcttccttgtcggctatctcccgagggagaatcttgccccggcagagggtggagaagtcgctctgtcggcggcttctctcccttgtcgtctttgtcaggaacaggtagcagtaatggttcaggaacgggcgttcattgaagtgccgttcaaaggagcggcttaaaaaactaagctcgtccctttccgtgtcgggctggtagttctccttgatgaagaagtcctgcttgtgtactatggagtagtcgggcagcaccttgattgccttgtaccatgccgaatgtatggcttcgtactcggcactggtgacggtgaacagttcgggcagttccaccctgaaagccaccgttatgtccgcatcctttgaaatgatgcagccgttctccaccgccaaaagtggaaatttcctttccagcgtgatagcctttaatatattcctcatgttctttcttcctttcttcttttgtaattgaacagccggggtatcgcctttcggctgataatgaagcgtgggtgtcttttgcgtgcggctgctttcatcagcccgtgcgtgccgtaccgtgcgttgagccggaacgtctgccacacgagcagcagcgaagccgacacgatgaaaccgatacatagccactggttcacgcctgccatgaacaggacgatgaacaccacgaagacggcaagcaagccgccgcaaaagataaagaggtactggcttttcagccccttgaactccaccggcttcccgatacccctgtttaccggatattcagacatagccgccgttttataggaagaacgaacgcaggatagtggcggcgacaattaaaaagatacacgccccgaaccaactggcggcagtctttgaggtgtcggggtcaccgcttgaaaatttgttatatacttttaccccgccaatcaagccgcagaccgccccgattgcgtacactaattttgttccggggtcgaaatacccggtgattaggttcgtggcttcggtgatgcccgcctgcccgttgccctgtgcgtaggcacttaccgcagcggcaaggatagccgccgacaaaaagattttctttctcattgtgatttgttttttatgccgggcggcgggtgggaagtccgcctttcccggctggtgaataatttgaaattttagtggtcgggagcagtcccgtttgtctgtttggttttcaggttgccaatcaaccgtaatcacgttgtttcatactgtcagatttatgcattattatattataggaaatcgttcatgtcgaacgcttcgtgttccttgcttgcatcgccagcttcggcagggacagcagccacagccagttccgcttcgttgcgtcccagcagttccgccacctttgccagcccgccgttgatgttctccaccaccgcatcgtagaggtttgtcccctcaatgcttgccagcgtcccggctgcttgccgttgttccgcttcagtggggttgtcggcgttcgccgtgcgtaccgcttcgcccagttcgtcaaagctcacgcccgtagcccgcccggtatcatcgtcaccgtccatgtacccggctatttcctcgtcctcgtagtcgggttcgtcattctcgtaaccgggcgtttcttccggcagtccgtcagcctgtggcgcaaaaatagtatcattttcagtcgcttgcgggaggtgtcccgatttgtcctgcgctgtcccgattagtccgcccttgtatcggctttcacctatcagcgtatagtctgaaacttcgtttcgtggaagcggcgcatcatccgttttgcccggtgatgtccggctgtccgtgtagcgataccacagccatagggcgatatagtacaccaaaagcccggtaagtatgcaatagattaccatagtcagacaggcttttggaagtggctttcatacagggtgtttatctcatcttggtattgctcaaagtggcgcagtaaaatattctccacatagctgcttatcgttaccttgcggccgcctatcaccgtcacgatacgcatcagtttctcgtgcgttgaacggctcacgtacaagggctgtcggtctgccagttccactttctgaaagtaggtttcccgatagtcacccgaaccgcctttgcgcttgcggggtgtcggtttctctacttgtaccgtttccctctgccgtccctcgtgggcggtttccgtttcaccgccgggctgcggtacatcatcaggctggctttcccgcttggcgggtacgccctgcgaaataagttctttcatgaaatcctcgtctatcttcggcatcccgccgctttgccttgccatatcattgtaatttgatgtaatacactatttccgttatcagttcttccaagttgcttccccttaccaacgggcggctggcaggaaaaagcgtggagcggaacaccgcctttctatccgccaccagttcttttttgtagcgtttggtatcggggataaaggttttcatcagtggcagttccagttccttaatcgtcttgtcgtaggcggtgtaaaggtctgttttctcccgcccgtccaccatgttccaaaagaggtacagcccggcaagtcggcaggtttcattcttcaccaatagcttttggatagccatagcaaacgacaggctgctttccagcaccaccttgtcggctgaaatcggggtgaaaatataatccatgcccgcaagggagtttatcacgccctcgctgttcaccgtgccgggcaggtcgaaaaacacaatatccggcacgtgtccggcggctatatattcgtcagccgttgcaatcgccttttcgggcgagctgcacaataccgggtaggctttcttccccagccgggtgaactgttcatacgccatgcgcttgtaatcttcatccgccccgacctgctcggcatcccgctttcgcatcccggcaatggagtgttgcgggtagtcgcaatcgaccaccgccacatcgtagcctttgaggtagtagaggtaactcgccgccagcacggtaaaggtggttttgccgaccccgcccttttgggtggaaaaggctacataaaggggtgttttctcgttttccatattgctttcgttcattattggttgatagatttatttattgctttcaatcaatccagccatgtagctttctttgtttccatattgcaatcttgaaatattgaaagactgttttatttcaatcttgttttcctgctttcattctttcttggaatattgaaataatgcaatcatgctttcttgaaatcatgctttcaatcattcttttctgattggaatatttctttcaatcttgctttcaatcttgaaatccgatgcaaaaaaagggagaaaaaacgtcccctgaaaaccttgtcccgatttgtcctgcgctgtcccgatttgtccaccaactgcctattttacagcattataaatcaccgttactttgcagcggagtaacgaaccgccgggggcgcaggtgtaaaaccgggctggtgaacggcagggcttaccgttccacgctaaccccaatccgtccgtgacggatttcgattttcgtcagaaaatagcaaggtgtgttctatggcacatagaaccgttttccgtgcctgaaaacgccttgccccttgcgggggtaaaaatcactccgaagtcgtaattttttaatccaaagaagcatggaaacaagaagaaccaacaagggcggtcgccccgccctcgcagacccggcgaagcaccgccatgtcctctacctgaacgaccgggagaacgcccgcttcctctcgcagtgggagcagtcgggcgtcacgagcaagtcccggttcatcgccgcccggctgttcggcgagccgttccgggtggtgaaagtggacaagtcggcggtcgagtattgcgcccggctgaccgaattttacgcccagttccgggcggttgcggtcaattataaccaagtcgtaaaggcgttgcacggcaacttttcggagaaaaaggcattggcttttctctataaactggagaaagcgaccaccgaactggcggcactgaaccgccaagttattgcattaaccaatgaatgcaaggaactatggttgccaaaataagcacgggtggcaatatgttcggcgcactggcttacaaccaaaacaaggtggacagcggggaagcaaaggtgcttttctccaacaaaatgctgttgagtgaggacgggaatttctctatcggcgagagtatgcgcagctttgaaatgcagatgcccgtccagctatccaccaagaagccgatacttcatatttccataaacccgcacccggaagacgtgctgaccgaccagcagctttccgacatcgccaaagagtatatgcggaagttgggctatggcgaccagccttatttggtgtacaagcataccgacatcgaccgccaccacatccacatcgtggggttgcgggtggacgagaacggcaagccgctgaatgacaagttcgagcatcggcgcagcaagcaaatcacccgtgaactggagaagaaatacgggcttcacccggcagaacgaaaggagcgtgccgaacgcccggaactgaaaaaggtggattatgcagccggggacgtgaaacaccaaatcggtaataccgtgaaagcggcttgctatggctaccgcttccagtcgttcggggagtacaaggctttgcttgccgcttacaacgtgtgcgccgaggaagtcaagggcgagataaacggcaagccctatcagggcattgtctattccgccatgaacgacaagggcgaaaaggtgggcaacccggtaaaggcttcccgcatcggcaagtcggtaggttatgaagcggtgcagcgcagaatggaaaaatcgggcgaagtaatcaagaacgggaaactgaaagaacgcacccggaggattgtagccactgccatgcagaccacacgcaaccgcaaggaactggaacagcagttaagaaagcagggcattgacgtggtgttccgtcagaacgacaacgggcgcatctatggcgttacgttcatcgaccacgacagccgggtggtgctgaacggttcacgcttgggcaaggagtattcggcgaacgtgttcaacgaacgcttttcgggcgaaaccggaaagatgcaccagcccgaagtggaaatacaacaacgggaacaatccacgcatcaggaacagccgggcttcacgccgaaagccgacatcgtttcgggcgtggcttccgtgctgggtgctttcggcggtttgctgggcggcggtgcatcaggcggtgacgagccgcaggacaccgcccgccaaaagagaaagaagaaaaagaagcgcacaaggcgtatcgactaactaaaaaacattacaatcatgcaacaggaagatgatttgagagggcttgcacgggtcatggactttatgcgggctgtcagtattctattcgtgggaataaacgtgtactggttctgttactccaccctgaaagagtggggagtgacctttgaagtgatagacaagatactgtggaacttccagcgtaccaccgggttgttctcgtctatcttatggacaaaacttttttcggtggtgttcctcgccctgtcgtgtatcggcactaagggcgtgaaagaggaaaagataacgtggacgaagatacactgcagccttgcggctggtgtcgtgttgttctttctgaactggtggctgctggaacttccgctgccacatacggcggatgccgtgttttatatcgccacactgtcggtgggctatatctgtatgctcatggcgggtacatggatgtcccggttgttgaaaaacaacctaatggatgatgtttttaataccgagaacgaaagtttcatgcaggaaacaaggcttattgagaacgagtattctgtaaatctgcctacccggttctactataagaagaagtggaacaatggctatattaacgttgtaaacgtttttcgtgcgagcatcgtgttaggaacgccgggcagcgggaagtcatacgcagtagtaaataattacataaaacagcaaatcgagaaaggttttgcgctctacctgtatgattataagtttcctgacctttcggaaatcgcttacaatcatttgcttaaccacttggacggctacaaggtcaagccgaaattttacgttatcaactttgacgacccacgcaagagccaccgatgtaaccctataaacgccagcttcatgtcggacattgcggatgcttatgaagccagctacacgattatgcttaacctcaatcgaagctggataagcaagcaaggcgatttcttcgtggaaagcccgattattcttttggcggctataatttggtatctccgtatctatcaaggcggtaagtattgcacgttcccccatgccattgaactgttgaacaagaaatacgccgatgtattcaccattttgcgtagctatcccgaactggaaaactacctttccccgttcgtggacgcatgggaaagttcggcagttgaacagttgcaggggcagatagccagtgcgaaaatcccgctttcaaggatgatttcacccgccctttactgggtaatgacgggtgatgatttttcgcttgacatcaacaacccgaaagagcctaaaatactggttgtcggcaacaatcctgaccgccaaaatatctactcggcggcactgggattatataatagtagaatagtgaagctgataaacaagaaaggtcagcttaaaagttcggtgataatagatgaattaccgactatatattttcgtgggcttgataatttgattgcgaccgcccgaagcaacaaggttgcggttctgctgggctttcaggattacagccagcttacccgtgactatggggacaaggaaagccgtgtgatacaaaatactgtgggcaacgtgtttagcggtcaggtagtcggtgaaacggcaaaaatactgtcggagcgtttcggaaaggtgttgcagaaacggcagagcatgacaatcaaccagcgggagaagtccacctcgataagcacccaaatggacagcctgatacccgccagcaaaatatcaaacctcacgcaaggcatgttcgtgggggcggtagcggacaatttcgatgaacggatagagcagaagattttccactgcgaaatcgtggtggacaatgaaaaggtgaagcgggaaaccgcccgttacgtgaagttgccgcagataatcgacttcaccgacaaggacggcaacgaccggatgcaggaggagatacaagccaactatgaccgcatccgtcaggaagtccggcagatagtcgaggacgagataacccggattaagaacgacccggagctatgccatttgataaaagaggaagaatagctgtatataatataatgtatggagtgaagaacagccgatgtagctttacggttgttcttcattctgtttttttgtgcggtaggcttcaaaacgcactaatatttcgtgcaggttctttaatgcttccacagccttgcctatcggcggcatcttgcttttgtcgaaagtcagtttcttcaaatcggtagtgtaagccgtagccacttcgggcaacgccatgaccgcttcggcatccttgaatatcggtgcatcagccagcgacaaatgcgaacgggagtttttatttagtccgtcctctatcgtcacccggtacatggcatccaagaaatcttccgaatgcatgtaatcgttatattcctgattgtggtagagtgccgacaagtcgtaaacgtcacggatatgctttgccaacaatgcggctgcattctcattgtaagacagctttaccagccttgaaaccttgtcgcagatagtctttcgggggttgatacattgcgtttcaaaactttccagtccgtaggtacttatcagttcctcttgcccgatgctttcaagaaaggcggtcacaatcggtttgataacccgcttgtccgccgggtagaacatcagttttttgtccggcaggtcacaggattttatctctacttccaaatgttctttcagccccacgccttgaaatacattgtcatacgaaaaatacagtttgcggtaattaccgcccgtttccgacaaatcttccttgtatatgtcgctgttgagttcggctatgtatttggaaagtttcttgttcaatgtcttttccgcctgcttggacgcacctttatcacccgtgaacacgaacaagtccaaatcttccgagaagcgttctatcagcccgtaggctttggaaagtgaagttccgcctttgaagtaggttttatctgcatattcggacaaagaaatatctcgcaatatcttcgatacccagtaatccttttccacgtgcgactgctcgtagccgaaatgttcagccgccagtgcgatgatttccttgaacgcttccttgtccgaatgtaaattcatatttctattctatgccgttttataatccaaattgaaccgtgtcgtgggaagaatggtctttgccatttccgtttgcaacacggtttgtccaatgtcgcccaatatgtccgccactacctttctgacacgtggagggtaacttttcgccaaagatacgattttttccagttccggcaggtcatacttgttgaaatattggcttttgagccggttgtagatgtcctgcccggttgttccgggtatgcgtttcatgtcctttattgcatcgagcagccgcaagtacggcacaaggctttcatccgaatagcccatgcagtaggctttcacgcattccacgtccaagttcttgaaacggaaacggcgaaccgggttgggagtggctatcgttattgttgtggcgacctgttctgtcagccccattttattaaagacgtaagcccccgtgatataaccgtccagtttttccgtcaggtagcgaaactgttcgtcctgatagacgggcaactttcccaaccctaacatggatttcttagggcggtagtatgcccccttttcgatccgaaccaatacccctttacggctctgttcggagagcagcacagcaacattggcggtctttcccgtttcaaacgacaaatcccggaacgtgaatatacgcccggtatctatccgttcaatctgcccaagtatctcttttctgaatgaagccatatttatgtcctttgtttctacatgcaaagatagtatattatgtaattacctgcaaaaacataacaaatattttgccgaagatgttttctttttgtcgtgtcacctgataataggagaataacggaaactcaatcaaaggcttgccaaacgcttcacaaacgttccaaaaataagctgtatttcagtattaattttgatatgtggctcattattagcctattgataaaatagcaaacgtttcataaacgtttcataaacgcttcacaaatggctcgcaagcataatgcaaattttaataagtcgttgattataaggtataaggtctataattaaatggctcataaatggctcaccccaagagagtgattaacttcgctctctttttttatgcccttttcaattctgcaaccaatggttgcggaatttcatcccacccggacaaattcagacagcgcaggacaaattcggacagcctttggcgcccgtccaaatatagtatatttagtcgctacctttgggcgggactattcccataaccgctaaaatttcaattatttatggcaaacagaatgaccccgtccgcagaggggcaggaaaaagacgtgctgctggtcttggataaacagcagggaaaagtgagtgccgttaagggtatcgacaaggagggcaatttgcagaccgtgccgccgacacagggcggcgagttcatgcaggtggacaagaacagcgatgtgttcagcaacttcatttccaatttcttccgcaagtatcaggacacttccgggctggaactgttcagtgtcaaggcttccgaagtggagcaaaacgcaaaggcaatcgaggacaaccaccgcaaccctacaccggagggcaacaagcgggctgaaatgcttcgagttccgaagcccgacttccacgagttcaagcagggctaccgcttcgacccgtcaaaaatcgactgggagaacctgaaaaaagtcggcatcaccgccgacaccctgaaaaacacgaaggacttcgaccgggtgatgcgtggctacaagtcccgcaacacctacaccgtttcggggacggtgggcggcttctacctgaaacctaccgatgtcaagctctctttctatcaggcaaaggacggcacggtagtacccaagctgcacggcgtgcagcaggacgagaaactgttgcaacgcccgttccacgaacacgggtttaccaagcaggaacagggcaacttgcaaggcactggcaacttgggcggcatcgctgaaatcaaagacccgaaaagcggcgagcaaatccccgtgttcgtcagccgggacaggtacacgcacgaactggagtatatgcgggctgacaagtggaaatgtcctgacaccatttgcggcgtgcaagtcagcccggagcagaaagccgcctttgaagccgggcaagcggtgaaaatggaaaacctgcaattcagggacggcacgaagcgcagtgcctatttgcaggtcagtgcggtggagcgtggtttggagttcctgccccgtgccgccgttcagttcttgcagcagggacagcagcccgcagaacagcaggtagccgggataaaggacggcaagggcgttgagttcaacggtcatgtgcagcccggtgcacagggcaaatcccccgacaaggtacagccgaaagacgttacccccgccgccgagagccggacgcaggttgcggtcaattcggagggcaagaccaacgaagccaccaagcggggcaaagagccgttgaaacagggtcaggacaagcccaccgccaagcagaaagagaagcaggacaagagtctgaaagcggacaaacccaagaagtccaaaggaatgaaaatgtaatatccaccattaaaaagtatagaattatgattgcattgatagcagagaagcccggcgtggcaaaggacatcgcccgcatcatcggtgcgacccagcgtaatgacggttatctttccggcaacgggtatatggtgacatgggcgttcggccacttaatccagcttgccatgccggaagcctatggcgtggcgaacttccgcagggagagcctgcccatactgccgcccgatttccaattaatcccccgtcaggtgaaagcggagaaaggctacaaggcagaccccggcgtgctgaaacagttgaaagtgataaaggaagtgttcgaccagtgcgaccggattattgtcgccaccgatgccgggcgtgagggtgagctaatcttccgctacatcttccattacctgaattgccgaaaaccatttgtgcgcctgtggataagcagccttaccgacaaggcaatccgtgaggggctggataacttgcagccgggagaatgttacgataacctctacctctctgccaagtcccgcagcgaagcggactggctgatagggataaacgccacccaagcgttgagcgtagccgccggacagggggtgttctcgctgggcagggtgcagacacccacgctcgtgatgatatgcagccgctatttggagaacaagcatttcgtacccgccaagttttggcaactcaaagcggcgaccgccagcggggaaataagtttcaccgcccaatcgaccgccaagtgggaacagcagcccgaagccatagccgccctgcaacgggttaaagatgccggacaacttgccgtgaaatccgttgagaggaaagaagccaaccaagaaccgccgcttctgtacgaccttaccacgctgcaaaaggaagcgaacacgaagctgaacttttcggctgacaagacgctttccatagcgcaaagcctgtatgaaaagaaagtgatgtcatacccgagaaccggaagccgctatatatcggaggacgttttcgatgaaatgccggagcgtgtcgccctgttagggcaatacccccgctttgccgggtatgccgccgggctggacggcacacccctgaaccgccgcagcgtgaatgacggcaaagtgaccgaccaccacgccttaatcattaccgagaacctgcccggcgaactctccaaagacgagcgggcggtttacgagctggtagccgggcgtatgctggaagccttttcgggcaagtgcgtgaaagacgttaccaccgccgtattgtcggctggagataccgacttctcggtaaaagggtctgtgatgaaagtaactgggtggcgtgccgtgttcggcgaacaggaaacgggcggggatgaagaagccgccagcctgccgccgcttcaagagggcgaaagcctgccgatttccaacgtggaactgttggagaagcagaccaagccgaaaccgctgcacacggaaagcagcctgcttgcggcaatggagaacgcaggcagggaactggaagatgccgagctgaaagccagcctgaaagatgccgggataggcacgcccgccacccgtgcggcgattatcgaaacgctgttcgcccgccagtacatcgtgcgtgagaagaagaaccttgtgcctaccgacaaggggcttgccgtttacaagatagtcaaggacaagaagattgccgatgtcgaaatgacgggtatgtgggaaaccgccctttccaagatagaagcgggcagcatggatgccgatacgttccgaaagggtatcgaggtgtacgccgcccaaatcacggcggaactgctttcggtacaattatctgttgcgggcggtgaaacctgcccctgcccgaaatgcggtagcggacgcatcctgttctacccgaaagtggcgaagtgttccaacgtggactgcacgcttaccatattccgcaacaagtgcgacaagcagctttccgacaagcagattgtcgagctggtgacgaaacgcaagaccggtctaatcaaggggttcaaaggcaagaacggcaaggctttcgatgcttcgcttgtgctggacgaacagttcaatgtcggtttttcattccccgaaaagaaagcgaaaccgaagaaatagcctatctttgccgctgaaatttcattgtggtaggttttacaacttataataattgaaattttagtggttgcgcccggcgggaaccgggcgcattttttatacgctcccgccaaacaggtaggtcgaacagaccaccccgttatccagcaccctgctttccgagagtttccaatgtgagccgaatgtttccccgataaagccgatgcctttgcccaccatgaccgggacggtgtatattgtcaggcagtctaataatccggctttaatcaatgaagtaagcagcttgccgccgccaaccaccactatgtcggttttctgtttcagttcatagaccctttgcagcggttcttcggtcaggaactccacgccgcagtccggcgttacgttggtgtcgtagtgtgacacaacaaaagaccgcttgcttttgtgcggccacccgccccagtgttcaaagatgtagttgtaggtgttcgcccccataagcaggcaatccgcatccaaatagtatttgccgatgatagctttcacttcatcaggcaaccagtccagttcttggtctaaggtggcggtatgcccgtccagcgatacggcgatgtgcgctctgatttgttccatattgtcaggtattaaagtgatataaatccctactgtctttgcacgttagccgccacccccaaaaagaaagcgtggcatgacgctgtttcaaagtagaggtactggcatacccaaaagaggaaacagtgcagccacgctatgacaaacgcatagcatatcctgcgctgaatatcccctctttttgaaaagtgccagttttctactttgggacgttcggcgaacgtatatgttatatataaaggcaatattccggcaaccgccgtccaattgccgttacttttccgtgtaacttctgcaaagttaagcaaataccctgaaaaatcacgtgcaaacagaaaaaatcctgccgtgttatcacaacagggcaggacacaagcacctaaaaatacacaagttcagcccatacgcctacgggcagcttgcgttcctttgaagattatatgaaccgatgacaaaacagctttggttcgccgtgtctttggtgatgatgtccctttcccgcatgaagcggatatagctctttgcggtacgttccttgatgtccaagacctgctgcaactgctcgcaaaggtctatgtaggtgatacgtgtctgccgcccgaagatgtcacgtgcgacattcaccagttccctttccttgcgcttctccttttcctcacggggcttctcgcccttgtacacgtgcatcccgacttccttgtcccaagcaaagagcatcagaggaacgtccagcggacttccgtcccttactttcaaggctttcacgaccgactgggcgggttcttcgtctttctctatcgaaaggattgtagccgccttacgctgcaactcgctgcccaaatgtccccgcagtttcaagccgttcggaacgaagtgcagcacacaaagaatacaggtgttgtagatgcccgccaaccgataaagttcatctatcaccgccacgctttccgcttcatcgttggcactcttaacaaggtctgcgatgccgtcaatgacgaccaactggatgccgccgtactggtagtagaacttatccatgctctgcacaatggcgttcaggcgttccttgcgtgacatacccgtcaggcagaacgctttcagctcatcgggtttgtccggctgtttggcacgtgccagcaggttgcttacattcttgaacagttgcacttccgactgttcggtgtcatatagcaagaccgccttgtgcctgccgttggcggttatctgtatgcccagcgtatctatgtccgcaccagtcgggcagatgcagcccgccacgattgcggctacataattgctcttgcccgttccctcgcccccggtaatgccgaacaggttgccttgtgtccctaacggaacgtcacccgccgaaataatctcttgcgctttggcgggcgggttgttgaaatctatctcgcacgattttagcataatcaatgtgtcgctatacaggttgtctaaaaattcgataaacagtttcaggaaatcttcacgggtgttcccggctttgaagtagtcggatatgtccttttcctctttcgttcccggaagcgggagcagcagccgtttcacgccaaattcttccaatagcttttcctgcttgcgtgaactttccctgcccgtcttgtccatgtcaaagagcaggacgatgtgcttgaagcggaacgtcagccgataaaccagcgtgggcggtatcgtcaccgtttcgctgttgaagcagatagcgtgaaaaccgtgcgccgccagcgaaagcacgtctttctcgccgcccgtgatgaatagcgtgtcgcctttggcgggcagttgctccagcccgaaacagtagttttcgccgaagatgccgccatagaggaagcggggcgtggagaacgggcggtacagtttgatgtgctgtttacccttgtagccgtacatgggttctgccaccgatgaagtgtaggtgtacggcttcccctctgccgtttcactattgtattcccggagcgaacagaccttgtaatattccagcagttcgggcgtgatgccgtactgttgccagtacaccagttcggcaagcggaaacttctgttcccggaactggtagggcttgacgggcttttcgggtgtttcttcgggtttgtccggcactgcccggcggacggttgccgggggaacggaaaccggagtgccggaagccagccccaagcccaaatcccggtcgatgatttccagtatttccacgaagtcagccgcccggttgcagtccagcccctttaactgtcccacgaggaagaaacaatcgccgctgtaactgtcgttgccgaagtctttcatcttgtagataccgccccggcggtcgaaatagatgttgcaggaagccttgctgtcctcgtacagcgggttaaggaagttgcgacctatgcgccagttaccgggcaggtagtgtttgaacaccgccagcccgttacttgtcctttctaagatttcctctttccttagcatacagttggtggttggttatcaggttgtcgatgttctccttgttgctcctaatcaggcgttcttccagcatccggcgtatctcgctgaccttgtagaaataacgtcccctgatgttggaataggcgatagtccccgacacccgcaggcgttgcagggtcttttcgcttattttcaggaacgtgcagacctcgtagctgtccacccacatgtcttcctcgctttgtcttgccgtttccacgtggttgaagatgtagtcggcaatggcggtaatcttgttgtccagctccttgtaggctttggactcgaatgttattatttccataatggtaactaattgatttgccgcaaagttcgggtgtcctgaaaaataaaacgccacaggcgaacccacctgtggcgaaataaattttgttaaagaacggttgcctaatcctgctccctcatgcgcagcagcaacctgtctttcagggtggagaggaagcccgtgcggtctttggtcttggcttttagttccatgtaggtgtggtagaagtcgccgaggtcgatgtcgaaaacatattcaaaataggctacaatctcctttatatcaaccgttcccttgttcagacagccgcaggcgtccagtgcgtagacaagctccaccaacgccctttttgtccccgtccagcgcagcacctttcccgtgaagccgttcttcacccgcttgcgctgttcccggcgttccagctcgtgcaggcggttggtgaggtatatttccagcagttcgttggctaaaatctttgctaccttgaagtcgtgactggtgctgaactgtgggtctgtttcgtaatagaaactgtccacaatgatttgtatgtcaggcttcccacgcatgaaatactgtctgtccaagtaggtggctttcgtgcggtggtactggtagaacgccaagttccgctggaacgactttgaaatccggtcggtttccgacagcaggtagtcccgctgcacgtcctcgctgccgctggggaagcgcacctctatcttgtaaacggtattgtaatagatgattttgctcgctaaaagcggtttcagttccttgaagaagcgtatttcttcttccgtgctggcgaacgggtaggagattataaaggttttgagttcgcccagtatctcttgcaggtagtccacgcacaggcggcagagcgtcagcgtgtccgctgcggtgtcctcgtattcctgtatctgccattccactttttgaagcagtccggcgaagtatgtttccaacagtatcttatgttccataaccttgtgcttatcttttatgaagcacaaagttacgggcataaaaattctgttttattcttgatttttcacattacgttcttgtagctgtgcattttcttgtttcctgcgcttttctgcgtatttctccgggggtatctaaaagatacgccttgcagaagtcgttcaggttcgatgtcgatgcgaacccggtggtgaacgccacttcggtaagcgtgaggtttgtgttcatcaggtagtgttccacgtcctttacccgttcctttatcacccattctttagccgtgtacccggtcattttctttacctttcggcggaacgagccgtattccatgccgcatttgtccgccagttgctcggcatcatagaccatgtagcctttcagacgtaccatttcggtgaacgtctgcctgcccagttccggcagcatccgttcggcgtggcgcagctccttttccgtcaccagcaggcggttgtcccttaccgggtttctccgcagcaggtggaaagcgtggcataccgtgttgtacacgttgcagaggtactgccgtcccggtcgcatccagtggagcgtatcgcagtaggcggtcagttcgggtatgtcgtcccgcttgcggtgctgttccgccagttcgtccagtatggcgtaatgtgtggtggacatacccagcaggatgatgattgccttgtagtccttgtatgccgccagtgtcggcgtttccggcaggcttttgagcgtgtcgcacacgtgggcgcacagccgcccgtccttgctgaacggttcaagttccaagtagttgtccattttccggctgttgtgcagcagccatgttaccttttcgtccagttccttgcaggacgcttccagctccgcttcgggagcgggatgcaatagtgatgtaatacgttgttccatatctgaataaattgatttgtttcctgtacgttacccggtagcccatagccagaccttttggattaaccgccaaaccacgtgataaaggaacatggcggcaagcataagaaaacctgcccgcaggaaatattcttcaatgcgctgccaaacgctcgtttttcgttcgggcatcagtatgtccgccacttcctcaaaggtcttgcaggcgaaaatcgcttgccggaactcgtctgcgctgttcctacattcttccttgaaccaccgtgtcttggggtatcgttccgctaccagttcttgcagttttcgtagtgggaacggttcggggttgtccccgtactcgtattcaatggaaatcacacgtccctgcatcctgatacaatatccgaatatcccttgccacttcactttgtgcgcccccttttcaacatatttcgtcccggttgcatccactacaatgtagttcttccgcttcttcaacaactcggtattggtcgttgtgtacagttcttccttgcgaaacacgtatatcatgttgcctttgggggcaaagctgaatatcgggtatttaagtcgggctttcattggaaatagtctattgttttataaaagcaaaataaagcagggtaacacctaccacaaccccgaaaaagatacaacctgtaataatgaaagcccaatcggggtaatggaaatcaagttcttcataaggaatggcagttttctttatacatctgttccatacccatatcagaacttttccaaatctatttactgtgataaggttactcatattgattaatggctaagcggggaacgctgtcaagcgttatcacgcttcgttatctatatttttaactgaatcagaatggaattttagaagcataagccgcataatattttccttatcttcccaatattcctcgtctattttattcaacttggtgatttcgttctctgtcaaatgcttgggaatatcccatagctcttgtaattggctgtcattttccaatctttggatgatgctgtatgcctgtataagaagttgttctgtatctgttgcgttaattgctcccagtcctttgattgcaagcaaataagcatcatagccccaattacagaagaattgaagaaacccaccattatacatttcaagttccagccaatataatgcggcgaccatactgtctgtttcccccatatcttgataattgggacgaatttctgtaaacttacgtccaataggggaaaaggattgctcccaatattgttctaaattttccattcttattgcttttgttatagataatggtttgcagcttgccgccgttaggcggaacaggtgcatgttataagctaaatttcgtattcaatcttgtaatcttcatatacattgaataccgtttcacaatcagataaaatactttcaagtaaaggtttgacttcactattccaatccaacttacccaaacctgcacctattttcgggagcgacacagtttggatacctctgctttcgcacacttttttcaagcgtttcaaacctttattcagataggtaagttccgcatgatacatatcgggttgtgtagcgatgtaaattatacccggagagaaacctttgatttctcctatgaacacatcgccagcttgaaacttagtgtttcgtgtgtacttcttaaagagcttttggatttcagggaattgacttgacagcttaaaggcaagcccagttcctaatccttcttgtgagccaatagctacaccttgtgctatgtactcatctttactctgtaatatatctcccgaaatgtattttatcatattgtttccgtttttcagttgcttataatggcttggtgagggacagcgttaagctgtttcctcgaccttgttactaacatagttcttataaatcacctctttaagactttgtgccgtttgagataattcgtacttttcttgcattagaaatggtaaagatttctttatcattttgttttttacgaaactaattgtttttcctctaataactcgtaatcgcaagaaagcccatatttcaacgggtataaaacgccaaattcgactataaaactctcgttggaaagtatcatttcgacattgcataaggtgataatcgaccatttcatctatcgcaagattaatagaatcttcatcatcagaatctatcaattgcaaaaagtttttataaacagaatgcattggtgtatctccaatatatttgtttaataatgcagacgaattattatcagtgagtaaatcatataatataaatacttcagggaataaggtattcttataatgaacttttttatccatttcaatttcataatctatcacatttaagaaacattcaaatgcaattttagcatcttgcgttgataaacaagtaagaatacctaacatacagtgacacatatctatgcttatgatatgcaatcgagctttctcctctttatctttaggaattactaaaaatgccataaaatcatataagaatgcgtctgcaagacctgtaaaactttctttgttcggttttgttatgcacgccaaataactttttagcattgtcatttccgcataacaagttagttctgttgaagaacaagaatgatatgtttgatttaagaagtacccttttattctcattcctaattcctcataaaaagaactattttcccgttcttgataagcaactgcttttttcaaattcttaaagagggtttctattgtcatcaattcttaatctttagctgaattgttagtaatggttagcagggaacggcttgccgttatcctgcgttgttagcaacctctttaattctcacttgatatttttgtaattgccattttttatcaatcaacaaatatgttgcagacaattcgcttttagcatcgtctattatccaagttaaatattgaacttttataccttgttcattgtctgcaaatctttttgctattggattccccaataattctatgctgcgttcataagaaactgtttcaattacagacaatttatattgcccattttcgtcaggtagccataagttctcaataaggaataaccgcatatcttccactaagtctttttctattactttaagaataggaagtttgtaaatgtatttatgtatattgacagaaaaaaacgggaagaagtatttacccattattcttcgttgcatagatatattattcttatatggattaaattcatctactggcattattaaatccattcctaaccagttctcatctttgtaaaaccgcacctttgaatttattccccgtgtagtgtacaatgctctgaaacaaaaagctaattcaaaatctatttgattatactttttctcaataatttccgaaaaggcaattaactcttttcctatttcagaaaccttaatatatcccggggaatctgattgtatgcttattcgttccatatttgttgatgttatggttgctaatggtttggtgaggaacagcgtttagctgttggctcgaccttgttaccaacctcaattataattcagagaaatcaaaaagattgaagaacttatcaaacttctcttctgttctacatgacaaaaatattccgtcatctgttggtgtattgtcggctttatagaaataccaaatcagattatcttgatatgcatatatgattaaagcattatattgcacaactttattccattccttttgtacatattccaatatagcaggataggcttcttcgttttcagctattccgccaaactcaaagcctccttgtgcgcaattataatacatcgttaatagaataaaatccattaatccaatcggttctgttatccaaccttcatcatcactatacttaacccaaattgtggtatcatgtattgtagtagcccataaacacacttcttgattttccgcaagaaagataatcttttcaccatcagattgtaattcgtctaatggcaagaaccgttggaacgaagaagccaatacctctacttttccaacagataaataaaaatgctttagagcttctggcattgttagtccaagcatattttcagcctgtttgatttcatccgttgtgtaaccgtcatttgcagttaattttctgcctaataactgttctgctgtttgaataatgttcttcatattttaattgttggtaatggttcagcagggaacggctcgtccgttatcctgcgttgttagctgtattttagtcaaaagtcatgtaacacaaacagacttttaacaagataattttctactgtccatacggcataatatccgcctgcaccgtcactgttctgcgtgctgatgaacagtgagtttcctttacccaatgccacgacaacattgtttcggctcggttcgtatagatgtgttatgtatgctgttggaaattccaatattccggcagggtgcttgacggtgacagatgcgtattcttcatgcggaatattatcatctatgcctgtcaagtcagaacaaccgtcaatactccgaacaaaacctgcttccaaatcataaacaatggcatgtttttgtggattaaacttttggaagtctatctttacggttaatgtgtcgttggcatatacaaggcatttatccgtactttgcggctgtttcttcaactgtggcaaatctgccagataacgtatgcggcttttatggatttctcctgtatgggtatttccattcgggcaagtcttggttatgcccgtttctgctccatattctacgctatgccattctttatggctcttttgtgcatcccaatcggcaaatacatgattatccaataatttgcctatcactgttccacttgtatcacgtacatttacatatccgtccgcatcctgaatgacaccgaagaaacgctgttgtgcttgtataggcaagcaaaacagaattgccgatatgtagaaaataatctttttcatgcttctattacagctaatggctaagcggggaacgcagttaggcgttatcacgctttgttagtcacattattattcttgcttataaattcataacagtcatccaaagaatattgggctaaagcgctttctatccatttctcataactatcgggaagtttttcacattcaggatgtgtaagccaatacgtttcaccatatagagcaagcattgcccaatgataaatgttttcgtgagaaaagaaaacaatatcatcagtagtgtttataggctgttgtagaggatgaaagtctttaaccacttgttgtgcattctctatggtagtatttccatatatagatatgcactctttcaatagttcgcaaaacactttgaaatgaaagatgattttaacattttcatcctctgctactataatgtctttatccatactgttatcatttataagttattgcaagttgtgactaatggtttagcggggaacgctgtaagcgttatcacgctttgttaccgatgatttaactttcaaagtcttttgaattaacaagtccacgaataaactcctcaaaacttgctgcaagtgtagtaatcttataatcgttttcttcatcaatatggacaatacttggttctccagctaaaccacatttgcgataatccaagaatatcatatcatgcccggcagaaggagtggtgcatattgctacgccaatagttggatagccccattcttcaatccaaaaacgacttcccatttctccgcagagagagtaaggtttatctttatctattcccataattccacttatcgcaatatggttgtttgcccaagaagtcggagtttgggttgggaaacaagtattgacaggttcaccaccattacattgttttatcagtgcaatataagattggggcaatttataacccaattcattttcaatatctttaacttgttcgtcagtaggtgttgtacccacataatatttttgggcatattggttattatcccaaaaactggaaaagtcaaaatcttcaaaaggagttttattcatgactgtatattttaactattttatcggtaatgtttagaaaggagcatcgtcagatgctatctttcgtcgttagatgctaattttttggtatcaaggatattgcccgatactatattttgaataccactgaatatatcactgccataataataaacaagattgtcgtaatcagcccacacttgttcttgttcatctaaccacacaatcaaatagccgggatgaatgtctgctaaatagataaccttattgacccctaacttcaaagccactttttgcatagcttccgggcggtatttctttattttcttgacatcaaaataaagaatatcagattggttcagctctaatttcatgttatagaatagagcaatcttgcttataataccttcattcaaaggataatcaaactttgaataggattgtttcaatttatcagcgtaataatcctgcataatttgaaagttaaattcatcccaatggttatgaacaagtattttctttattgcagtaggtatattcatatctaattgtatctaatggctaagcggggaacgcagttaggcgttatcacgctttgttagtcacattattattcttgcttataaattcataacagtcatccaaagaatattgggctaaagcgctttctatccatttctcataactatcgggaagtttttcacattcaggatgtgtaagccaatacgtttcaccatatagagcaagcattgcccaatgataaatgttttcgtgagaaaagaaaacaatatcatcagtagtgtttataggctgttgtagaggatgaaagtctttaaccacttgttgtgcattctctatggtagtatttccatatatagatatgcactctttcaatagttcgcaaaacactttgaaatgaaagatgattttaacattttcatcctctgctactataatgtctttatccatactgttatcatttataagttattgcaagttgtgactaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatgtctttatccatactgttatcatttataagttattgcaagttgtgactaatttatttataaccgcaccttatggtggcgttcctacacttctataactgcacctcacgaattatccagtgtatcaaggggattagggatttttgctttatgggcacttgacacatgaagataaatggttgtggtcttgatgtcgttgtgtcccagcaattcctgtatcgtgtgcaggtctgttccctgttccagcaagtgtgtggcaaaggagtggcgcagcatatgtacgtgtacacggtgtttgatgccagcacgatgtgcggcttctttcagcactttcaccaatgcacttgccgaatattgctctccgggtgtttcgccctcaaacagccatttttgtggacgatactcccgaaagtagtgccgtagttcttccagcaatttgggtgaaaggagcgaataacggcatttcttccccttgcccatgatgcgaaccgacattgtttcactgttgatgtcctgcggggtcaggttaagcaattcgcttcttctaagtccggcagagtaaaccaacgaaatcatgcagtgatgcttgatgttggaaatttgtgcaaggatgcgcttaatttcattcttgctcaacacttcgggcaggctcttgtactctttggcacgggtgataccgccgtagtattgccgtttgccgcctttcacctgctcataatagaacttgatagcattgatgcgcatattctgttgcgacaccgagattttcttctcgttcacaagatagagtatgtacttgttgatgtccggcactttcaggcggtcgatattccgtcccttgtgatattccatgaagtcgctgaaataggcacggtatgttttgacggtcgaggggctgtaacgcttctgttccagcagttcgaggtagcctttcggcagtgtgtattccctttttggtttgggatgccgcacgtaaacccggctgtaatcaatataggcgtggggtgaatagcggtcgtagaaatccggcaggctgaaagcggctgacgctatgtatgcagagccgttgccagtcatttccatgcctgtgtcttgggcgagcagttgggcgacagcctgactgctcgcatattctatccgtatgtagtctgcaccgtcccttgtttctttgtgcagcacgatgcttcctctttgtttctgaaccttatccatgtcgctgaattttgcttcatgctccaaagataaaacaaaaacgccacattttgaacatacgttcaaaaataatagaggttaaaaaaacaaaactgtatcaggctttaagcagcgaatagatatagcgaaagttttctgccagttcgtccacgttcaaaccgttcaggaatgcttgttcgtatgacagtcctaaaaacatttgccggaacatggtagccgttttcttcacgtccgtgttacttctgatttccccgctgttttttgctttttgtatgactttctcccataggtcatagtcttgtcggtagattttctcaattttctgcctgatgctcggatagtacatacgcacttgtgacaggaaatgaaagtagtagaagttagggctacaatcatgtgggctgctatcatcgtcaatcagttcaacaatccttttcatggaagcggctacccccgccacgtattgcccgatgaacttctccaacgtagcggcaggagcggcaaacttgtttcccggttcgtgcatttttaacacgtatttgtctgccacagccatgaataaatccagcttatgtggaaaataataaacgatgcccgtttttgtcaccccgcaggctttggcaagcgtgatgatgcttgctttctcgtagttcatcctgacaaataccccaaatgctttatctattacttcttcacggttagttattatcatacacgtttgtttttaatcggttacgaagatacggattttgttttaaccatttgtaccccagtgcttttttttagtgcaaggtgcaagtatatatttatatatatagcttgcaccttgcactaatccaaaaatatttattatcagatatttgcgagtttcaaaagaaagccgtatctttgaacccgaaagttaggcagacaaacagtggtcaaagttggacaggcttaacggttgaaaatcgttactgtttcgttacctatttgaaattttgaaagcaaagtagctgaaatataagcggttagagttgcaggttcaaaaccctctctctccgcaagaaacattgataatcaatgttctacaggataaacacccaactttacgtccaaactgtaaagttgggtgtttctattttaaggcttagtctgaatgacttttatagatattcaattatccgaagctttatgacgaatgttatagataagataaattctgtgtgtctgctttctgacgatacaatacaagcgttgaaagagagtgtgaccttatgccattttcccaaaaaacatttgttgataaaggaaaatacattttgcaagttcgcttattttatagaaaaagggatgacccgttctttctggcttgtgaacggggaagaaataactacttctttttcttgtgaagggggaattgtctttagcatggatgaattatattataataagttgagtgaagaatttgtagaaacacttgaagacgttgttgcatacaaaatatcactggctgacttgaacaggctttttcaaaccaatatcgaactggctaactggggacggattatccatcaaaatgaatatagacgtttgcagcgttcacataaggaacggcttgcattgccggccaaagaacgttacgaagagtttaagcagcagtttcctcaagtgtgccagcgggctaatttgggatatatcgcatcatatctggggatcaagctttctacacttagtcgtcttagggcccaaaaatgatttttatacgataagattttgccatagaacaaattttatgtttttcaagttgcgtaactttgccgcattattatgtaaccgttaacaaaaaacaaatttgtaaattatcatgcaaaaaggaactactactgcatttttagacacaaaacctcattatgaacttcttgacggattgagaggggtcgctgctctcatggtaatatggtaccatatattcgaaggttttgcaacaagtcccatggaccagcgatttaatcacggatatctggctgtcgatttcttctttatcttatcggggtttgttatcggctatgcttatgatgaccgttggaaaacgatgaaaacaaaagactttttcaaacgcagattaattcgtttgcatccgatggtggttctgggagctgttttgggtagcattacgttttgcatacagggttgtgagaagtgggatggttcacaggtttccatttcgatggtaatgttggctatgcttatggggatatttttgattcctgttgcgccgggggcaggtcctgaagtccgtggaaacggtgagatgtaccctttgaatggtcccagttggtctttgttttttgagtatatcggaaacatactatatgcattgtttattcgcaagttgtctacgaaggctctcacggtgctggttgtattggccggaatcggactggcttcatttgccatattcaatttttccggttatggtcacttgggtgtgggatggtcaatggcagattataatctgatcggaggtttcctgcgtttattgttttcattctctatcggattgttgatgacgcgtgtttttaaaccgcttcaggttagaggtgccttttggatatgcagtctggcaattattgttttgctttccatgccttatatcggtggtagtgaatttccgtggatgaatggtatttatgattctgtatgtgccatcattatttttccgttacttgtctatctgggtgcttcgggaaaaacaacagataaaaagtcatctaaaatctgtgaattcttaggaaacatatcttacccgttgtatatagtacactaccctttcatgtatctgttttatgcgtgggtatggagtaaagaactcagcttttcacaggcgtggccgatggcattggttgtatttttcggaaacatcttactggcttatctctgcctgaagttctatgatgaaccagtcagaagatggttgactaagaagtttctggcaaagaaataaaaataacatcactgtatcataaatgaaggggttgcaaaaatcgttttttgcaaccccttcatttatgcccggcatataaacttaaagtctgaccctctgctccccattatcctgcgtacagagatgggccaaagaataaatttaatctttccatcttatacaagacagatttcagtgtatataagaaaatcaattctcgtatattccgattagcccatccgccgtgatggtttctgcatttatttttagtttccggcatctgctattattgtagaagcggatgtgggctttgccgtccttgtccgtactaactgagggattccagtaaagagtacggcgataatcgggaacgggaggaagtgcggagtaattcggctggtagaactctttgaccggactatatccgtcaagccatgtttttctgacacctttgcctgcctctgtcggtattttgccttccggataggtttcaatcaatacggcgcaaccatataagtcggatacatcgaagggtgaaagccgtgggtctgcataccggcaaatagtggaaaggttttcagtaatataaatcgatttgatggcttcaagccttatatatttgtatttattatagtccatctcagtatgtcgggtacattcataattgataacgaagagcggcattttacttttgtaatataaataattcctttgtgggacagggctgaaattcttattcatattcagcatcagttcgtgtatgtcgtcaccgatgaattttccgctgtcctttatgtcgtccagttcagaatggacgtcataataagctattgattttgaacgactgtcgtaaatctctttttctttacttctttttttagctttgatggtcacctctttcaatcgatagttcttttcgtggttgcctgctttagacagtgaatctgtataggcggcaaagaaggtttcgatgtcgtcttctgtcaagacatttgtttctttatccggaatagtatcttcttcttttttcgtattggcgatgttcacctgcatgtcggcataatgatattttgcggggggagggctgaacaatctgtctaatagaatacgataatctttcttttttctgttgactgtcactgccaatatcaagtcccatttcccatagatatccgatatcagtgaaaaacgtcctaaactatcggtagtaatagcctcgatgaagctgctgttttcttcattttctccccgttttttcaaaaagcacgatacttctacgttgggttttggaagttgccggacgaaagaaacaacctggccccgtgtttcgatacctctttcgggaccatatttgaggttgagaggttcaattccggtcatttgcttccaagagtagcggcgccaaccctgtatcctcagtaacagatcgattgccatgcggtgtgtgtcgtcttccgcttcaaaataatagccgggattgcggacatacccttttatctcggacattaataggaggtcggtcagcatattgcgtcctgattccacttcattcatgccatctcttacggataaagcaaatgtgttttgtaccggttgcatttcagctccggttaaggtaaattccagatttactaattcatagggattgtatgtttctttgtctgtccgtgcttttatagataatcgtttttgagggtgaatgaatatcaaacggtcggacaggacttctccgccaccattgaataacgcgatacgggagactccgggtgtcaatctgctcttatctattttgaagcgaatgatttcatttccttcaacgtcgatcagacaaaacttgtgaagctttcctccgttgataactgctaatcccaatagagtggcgggagtattgggactcttttgcaaagcaatctccacactgtctgtgtatgacagattatcaacatgtagcgcataccctgttggcagggcttccggcatattaaactggtgttttttaccattgaactcgacgactgctttttgtttatcacctgtaggtgtgtaattgaaaactccccgtccgtcatggattgcggtgaaatgggctgtttcctgtttttcgtcgttgataacagtaccactcaatgttatggggttgccataggcatctgtcgcttcgaaagcgatttgtgactctattccctgaatcaggtttccactttcggggaagaactttaaatttacttttttgccttttgtcggtttggggcgctccatcgggtaatttcctgttgaatatttccgcatctctttttcagcgaagtttccttctgtttggggcttgtcgaagaccggcagaagtcttgaaaaaataatatcttccccaaagttaagcatgtatttcgtataggcacgaacctcgtaaaagcccgaataaaagggtatttggtttaaagtgaaatctccgtgacattgaccgttctctatttttaatatccgtttgtcgattatttcacctccgggattcaataattcgacatataaagttttactcaggtttgtggccgggtatagatcggaggtgaccagaaaacatttaaaccagatatcatcaccttgataatagctggtattatcgaattgcaggtaaactttctcctgtggaatatgttttgagaaattttctatcagacaggcgtattggctcaacttttggacaaggctgtctttgttttgtgcagatacatgaagacaaaacaggcataggaataagtatcccgtccatttttttgttgttttcatcttattatagcttggttaaacggttattcttattttctgctataccttgtttcaggtaaagttccttactgtcatgccgggatttacctcttgcagggcttttatcagttcctgaggtgactccgggtctaccatgacaaatccagtggcatgtttgatttttattttctgtatacccaaggcatggggagtatatgtaatactggtgatatgattgaaagagcgtttttgatggaagccgttcacaatttgcagcattccgttttctttgacgatgtatctactggttgcttgcgaaaagtagattgtcgcacccggacctaagcatgcagcgcctatccatattgcctgaattgttatgaaactgatgacaatgcaagctactatgcctatagcgaatagccaaagccctatcttgggatttcttgctttaaatgtttgttccatcttttttaagattatgtttgtaactgtctgataaagataggaaaaaatagaataaaagaatgaaataactttctttttttgagtattggctatgaaaagattgatttgggtcctatccgtgcagagatagaccggaaaaataattctttgccggtaaaccattaattctgcctttttatctatttttgccacttgagaattttttttatattaatctaactatcatgagacgaaaagcgactttactattgctcgtaacattcggactactgctcggcgcagtggcacaggaaaaaatgaaaacagtgatcgaacccttgaaaaatgaaagatggtggggaggattcgtagctttaggtaaccagatgccgtttggtgatcatttgcggatgcaggatatgtcacgcaataatatgaataatcaggtagttccgttcatgctttcttccgaaggccgatatatatgggccgagaaatctttctgttttgaggtgaaagacggacaattgattatctattcggattcggaaaagatagaaccggtaaaagcggggaatacactgaaagaagctttactggcagcctcggcgaaacactttccaccttcgggacagataccggaacctgctttcttttctcttccacagtataatacatggattgaactgatgtatgatcagaatcaggaggacattatgaattatgcccataaagccgtagaaaacggatttccccaaggcgtattcatggtagatgataactggcagagatattatggtaactttgacttcaaatccgaaagatttcctgacccgaaaggaatgaccgacgaactgcacaagatgggattcaaagtaatgctgtgggttgctccttatgtatcgccggacagtcctgaattccgtgaactggaagcaaagggatatttattgaaagataagaatggacgtacagccatcatccattggtggaatggttacagtgcctgttatgacaccacgaatccggaggctatgaatcatctgaaggaacagttaaaagccaatcaggagaaatatggtatcgacggatttaaatttgatggtggagacgttgcttatatgacaggagaatatgcttttcatgataaagaggccgatgtgaatacttttatggagaaatgggccgagataggtttgagctttccctacaatgaattgcgtgctgcctggaagttgggtggtcaggcattggtacagaggctgggcgataaggattattcctggcgtgcgactcagttgctaattcccgatatgactgccgcgggattattgggacattattatacttgtccggacatggtaggcggaggccagtttggtgcttttctgaatgtgaagaagtttgatgaagagttgattgtacgctcctgtcaggtacacgccctgatgccgatgatgcaattctccgtggctccctggcgcatcctgagtaaagaaaatgtagcgatttgtgctaagtatgcccatttgcatcaacaaatgggagattatattctgggattggcaaagcatgcttccgaaacgggtgaacctattgttcggcacatggaataccagtatccccatcaaggatttatcgattgtaaagaccagtttatgttgggtgacaaatacttggttgctccgatgctgacttccgggacaagccgtacggtgatgctgcccaaaggtaaatggagagatgatcgagggaaggtatttaaaggtccgaaaacaataacaatagatgtcccgctggagcgcttgccgtattttgagaagctgactaaatagtaatttctataattaaagagaaaagccacgctaacattacatagcgtggcttttgttttgggtttaaactacttctgtgttattttacacgaatgatgttgtaattcaggtcgctggcagatacttccaggctgtcgtcagccagggtaagggtagtatcattagcgattacgaaataaacaggttcgcttccgtcactcgggttcagtttaagagccgttttctttttattctttacggttttctccactgtcaccggttttcctttagaagtgaaggttttgtctttacctttgccttcggcatccagataagtgacgtccagtgtatacgttgtatcggccgcattcgccagtgtgttcaaggttaacacgtagcggatacccggaccgtcagcagcgggaagtacaccttcataaacctgagtttcttccatagtaggttccataaccactgccaaactgtctgcggctgcttcttcagcttttgttccttttgattggcaggataccaatgcagcaacaacggctgccaacataattacttttttcattgttaagtgctttaaattaatataaaaagtgagtgctattcctactcttcttctttctttatgacaagcagcttatcgaccctcccgcggtccatgtccactacttcgaactgcaggtttttataaatgaatatatctccggcttttggaatgcgtcctatcaggaacatcgccagtccgcccaatgtggtaaagtcttccgactcgatgtcatcataggagagaattcccatctcttccataaagtccccgatgttcatcgaagcttctaccaacaaagagccgtcctgtctgcgaacgatttcctcttcttcagtatcgtcctcttccagaatgtctccaaagatactttcggtcaggtcgtgcagggtaataatgccctccgtgctgccatactcgttaacaacaactccgaacttatttttgttcttcttaaatagctctaaaactttttttgcgtacaaactttccggtataaatagtgccggacgggtgatttctttcagatcaaactcctgttcggtgcctaccattaagataatatcttttacagaaacgacacctgctatctcttctgtattatcatcgatcagcaggtatttgctgaagtgtttatcttcgatggtctgaaggactttttctttactgtctgtcgtatgcagaacgatcaggtcgcgacgatgggtcatcagttcgttggcacgtttatccgaaaaccggaatacatcgcgcaacatttcggtttcttctttgtcgatgactccctgttccgaactttgatgcagaatcattttcaattcttcttgggtcatcagccgttcttcacttttcagcccaatcagcttattaagcaggcgggtagagatgctgagtaaccatacgaaaggataagaaattttagtcagcagaatcatgacggggcttaacagggttgcatagcgttccggattactaagagcaatggatttgggaaccagctctccgatgatcagcgacaaataagtaatgatgactactgtggtaatcatagcgaggtcttttgcataaggttcggctcccggaatcatagcgaaaaggggaactacatcgtcggcaatggccactccaccataagcacccgatatgataccgatcagcgtaataccaatctggatggtagaaagaaatttttcgggttcttccaattgtttcagtactccccgtgctgatttatttcctttgcttaccagggtttcaaggcgtgctttacttgaagatactaaggcgatctcgtacatggcaaaaataccattcagtacgagtaaaagaataatgattaagaattccatatagatgtgaatagtttcatgaccgcaaattacactaaagtacggactcatgcaaaatctatcgaaattattaatgaattttttcaaaaaaagttgaggccgaccctccggatgtgggggccggccttatgtaggatcagaaaatgttgtatccgggtttatttattcttggtgtattcgtcagctttttctttagctcgggctacgcgtttggctgtatccggatgtgaagagaacattttctggaatttggattctttcggggcttcggccgataattccaataatttgttcaatgcattgtacattgcgtatggatcgatattatgtttgatgctaaattcaaaaccatagtcgtccgcctctgtctcctgtttctgagagtattgcgcaccggccaatgcttccgccatggcacccagttcagaatctgacagtttagctacagtcgagctggcagctcctgcggcattttttacggccgaacggagataagcattcttcattgcatcttttgagtctgtatgaatcacgtgtccgatttcgtgtcctactacagccattacttcatcgtctgtcataatgtccatcagaccggcacaaatgcgtacactgccgtcaccacatgcaaaagcgttcacatccacaacctcgtatacgccgaaatttactttcagtccgtccacttctttgatgtgtccggtcagtttctccagtcgtttgccatactcactgtcagcagctgtcagcggattgtgggtatccatccattgcatatattctttgctcatagctgcaatgtcggcatccgacagcgtgattgctttagctgcgtcacttcctgcctgtaccactttgcctacattgatttttttaccgccgattttaaattgtgccgaggcagtcgtgaagcacattccacataacagtgctgcgataaaaacaattctctttttcattttagtaagtttttgtaattaataatatagttgtctatgtgtttaatattcaaatgtgattcctaatgtaggcattaaagttccgcttttttgagagatgtatttcatcttatagcgttgttcggctatcggagccgacggattttcgatgactcccgtactcatcaatatgtccggctggcggaacttgctgtttgtcacattttgcaggtcaatgtaaaaaccgagcatacagcgtttcaaatagaatgttttgtcaacgcggacatccagttgaccaaaggccggcaagcgtcctgtgttatattggccgtaatcataatagggtcgtccttgggcattccatgccgtcaccagagaggatttgtcaatatcgtaaggtgtgtagggtgctccgccgatgcaactgaccttcattcccagactccagttgtgaggaaagttataggttccactcatattgaatatgtatcggttgtcccaggcggaagctatgtattcggattctttgttgttgcggtattcacttttgaataacgtgaacgaagaggacagattcagctttttggctatcagccatttcatcagtatttctgctccatatgcccttccttgtgaggtagaacttaatgcttcattcccgatcactccgtaatcgtttcctttacaggccagaggtatcccgtcgacaatagagaatggtattttatcatattttttatagaaaccttcaatagataactcgaaggtattgcgtggacgccaactcagccctatgctttcctgactgactctcatgtaacggaggtatttgttgaccagtttgccattgttatccttgaatcccaatccggtataaggaggcaactgataatacagtccggcattcccgctcaagtagactccatccgtcagccgataggagagtgacaggcggggagacaactgatcggacattcccttcatgctggaagagaagttgttggcatcagtccgtactccgagtgaggtggtaaaccgttcgtcgggtgtagcataactaatggttccgaataatccccagcgccaaaatcccaaataggtatgataatcgaaggtcttgcctccatcgatataaacccgctggaaagtggtattggtatattgcgaatagtccaggttagctcccaaatttactttccagtttccgaacgtcgaggcattttctatccggaacttggtctcctgttccaccgagcgtaatttcaatgacaggttttttgcactactttcgtcgttgttcagatatttggtgttgcggttattcagataactgtggcttataacaacagattgtacatgggctccggcataatgacggtataccgctcccagtgtgaaggtttcctgctgaattttaggtaaatagctgaggatatattcggctttttctccgtcgagtttcgtgttcagtttcatgttgtcgatgccgccaagccccagtacagtcagttcgttagtcgtattgaaacgggttttcaatttgaattgtgcatctgtaaatgtaggcagaaatggtaggcccagcatatcgaacaggaattggaggtaagactgccgtactgaaaccagataggaagtctttttgccaagatgtccgttagatgctaaagatacctccgaggcacccagtgtcgccttgagtgaattgcgttccatgtcgccgtcacgcaatttgaagtcaagcaccgagctgagtgaattgcctttgtcggcaggaaaggctccggtatagaaattcacttcacggatcaagtcggcattgatgattcctacgggaccacccgatgccccttgtgtactgaaatgattaatgttaggtatttccactccgtccagatagaatcggttttcggatggagaaccaccccggacaatcaggtcgttcctgtatcctgccggagagaaagcaacccccggatatgactgtacgatgcgtgaaatatcccggttggctcccggacttttctcgatttcctgcaagccgatgatgcgtagtccgacaggactttccagatcacgccggaaaggggaggcggtgactgtgactccttccagttcggtcaggttctcttccgtttcgatttggatggtaagatctttagtggagacaatatattcgggggtaagtaccgttttatatcctaccgcagatgcctgaaggcgataaataccgggggggacttcctgaatgttgaagtgcccttcagcatctgtcaccgctccacgtcccagccccaagatcagtacattgataaattccagtggttggcggctggctttgtcaattacagtccccttgattttgtgcgttggttgcgcaccggctgccgtgagcaagcccaaaagaaacaggaagaaaacagtttttttcattggcctggtttcgatatactttgtgaattctgtgcaaagttatataaaaaaggttttggctctcgtttttatctgttatttttgtggggaagttttaaatataaattatgaaaaccataaagctgattacttgtaatgatgccgttcaagctcatatcattcagggagcacttgctaacgaaggcatcgactctctgttacataatgaaaatatgtcgacattgttgcgaggttatgtccgtgacatctccggagtagatgttttggtggtcgattgtgattacgaagcggccgtgcgattgttacagcagaatcagatgattcctgaagaacagaagttttgtcctttctgcggttcggatcaaatcaggtttgttcttaaaaaggagcaccggatgaaagccatcagcgctgccatcgcttctatgctggcaggtgttccgccgggagataatcattgggaatatatttgcagccactgtggaaaagcttttgagaaaccggttgcggaattcaatcctgttgttcccgaagtgggggattaaaatggtaaactctaaaaaacatagattaaaaatgaaaagaagaaactttattttggcttgtctgctcttactcgctttacctcttagcgctgcaaaagtggatacgctgatggtgaagagcccctctatgaataaggaggttcaggtagtggtagtgactcctgatacagcttggggaaaacaggctgtggaatgtcccgtgctctacttgttgcacggctatggggggcatgccaagacttggattcagataaaaccgaacttaccggaaatcgcagatgaaaaaggtattatttttgtatgtcctgacgggaaagatagttggtactgggatagccctaagaatccggcgtaccggtatgaaacatttgtgtcttcggagttagtgaattatattgaccggaattataaaacgattgccgaccgtaaggggcgtgccattaccggactcagtatgggaggacatggggctatgtggttgggtatccgtcataaggatgtgtttggagcggcaggaagcaccagtggaggtgtcgatatccgtcctttcccgcagaattggagtatgaacaaacagttgggtgaaatggcttccaataaaagggtgtgggatgaacatacggtagtcaatcaactcgataagattcagaatggcgatctcgctttgattattgattgcggtgaagatgattttttcctgaatgtgaacaaagactttcataaccggttgttggggcgcaagatcaatcatgattttattacccgtcccggtgaacacaacgggaaatactggaataattctattgattatcaaattctcttcttcagtaagttctttgccaaaaagtagggaacaggtgacaaagagcatctgggattataagtgccacttcttcctccatatatggagccttggtaggttcggatggatgggaggaagggctatttgtaagaaaaatgccaatatatgtaatgccccgtaacaatatatgtaatcgaaataacatatattgttacggggcattacttcactacttcgtgagggcagaggcaaagccgttcttcttattcaatattgatattgatggttctcgtatctgttttcgtttcattgtatgcattaccgtttatatcgatcacagtacccgtagaggtagtctttgctatgattccggttggtttgccgtctttatccagttcataagtgtattttgtatattcctcctcgtttccttccggagtgtttccgataatcagatactttgactgagtacccaacagtctggcataaatagcatcggtatggagggacagggggtaaatatcacaaacctgcaggcagggaagctgatacaggttcttcgtatttcccacctgataattggtttgctggccattggctatgatatggcttaaaattccgttatcgtatgccaattccacggaagaataaggcgtgccgtctatttcttcgttgatccgggtaagatattcgccggaatatgtaaaattatactttctgatctggctggacaatttataagtgcattcggtagcatatcccgtatctcctaaagtataggtggccgtatttccgttttcatctgtcaacgtcacttcgttgccggagtaggaaagagccacttcgtgtgtcagactttgtccgtagaactcttgtacagtggtgtggcctgttaatttattgttattgaatacgtaagtgtccgtacggtatacatcgcctccgtcactgtgcagattttccttcaggatcatttggttgaaattgggagtcgggggaagatcctgcttttccttatcgtcagtacatgccgaaacagccatgagagaaaatgataaaaggaaacagtataaaagtttgttcatatcaatcatgtttttatttgcctgcaaatgtagttaataacctctttatctaccacgattatggtataaaaatgcctttaatgtgcgatttcgttccctgccggattcctctatctttgcaacatataaagattggacactgacaatgaactctaaatatagatagcaaatggaaacgaaaaaattacattttgagactttacaactccatgttggacaggagactcccgacccggcaaccgatgcgcgtgccgtacctatttatcagacaacttcctatgtgttccgggattcggcccatgctgccgcacgatttggattgcaagacccggggaatatttatggacgtcttaccaattccactcagggagtattggaagagcgtatagcggttctcgagggtggagtaggcggtcttgccgttgcttccggagccgcagccgtgacatatgctatcgagaatatcactcgttccggtgaccatattgtagctgccaagaccatttatgggggcacatacaacttgctggcacatactctgcctacttatggagtaacaaccacttttgtagatccgtccgacctttttaatttcgaacgggctattcgtgaaaatacaaaggcgatatttatcgaaactctgggaaaccccaattccaatattatcgatatggatgccgtagccgccattgcccataaatatcggattccgctgattgtggataatactttcggtacgccttaccttatccgtcccattgagcatggagcagatatcgtaatacattctgccactaaattcattggtggacacggcagttcgttgggaggggttattgtcgattccggtaaatttgattggggcgcttccggtaaattccctcaactgaccgaacctgatgcaagctatcatggtgtacggtttgtagatgctgccggggcagctgcctatattgtccgtatacgtgccgtactgttgcgcgatacgggggctgccatcagtccgttcaatgcttttattctgttgcagggattagagactttgtctttgcgtgtagaacgacatgtagccaatgctttgaaggttattgattttctggtgaaccatccgaaggtagcagctgttaatcatccatcgctgcccgatcatccggatcatgctatctatcagcgttatttccctggtggagcaggttctatcttcacttttgaggtaaaaggaggaacggaggaagcgcagaaatttatcgatagtctgcagatattctctttgctggccaatgtggccgatgtgaagtcgctggtgattcatccggccactaccacacactcgcaactgaatgcacaggagttggcagagcagggaattaagcccggaacggtaagactttcgataggtacggaacatattgaagatattattgatgacttgcgtcaggcattagagaaaatttaaaaaatggatatagcagcattattatcaggaggagtagacagttcggttgtggtacacttgctttgtgagcagggatataaacctacacttttttacataaaaatagggatggacggagcggaatacatggattgttctgccgaagaggatatcgagttatctactgccatagcccggcgttacggtttggaactggaagttgtggacctgcatcgggaatattgggataatgtggctgcttatgccatcgagaagatacggaagggacagacaccgaatccggatgtgatgtgcaataaactgatcaagtttggatgttttgaacagcaggtaggaaaagatttcgatcttacggcaaccggacattatgctacgactttgcaactgggggagaaaacttggttgggtacagctaaagatcctataaaagaccagaccgattttctggctcagattgattatctgcaagtttcaaagttactgtttccgataggaggactgatgaagcatgaagttcgcgagatagctttgaaggccgggttgcccagtgcccgccggaaagacagccagggaatttgttttttaggcaagataaattataacgatttcgtccgtcgctttctgggtgaaaaagaaggggcggtgatcgaactcgaaacaggtaaaaagattggaacccatcgcggctattggtttcataccattggccagcgaaaggggttgggattggggggaggcccctggttcgttgtgaaaaaggatattcaggataacattatttacgtctcacatgggtacgatgctgataaacagtacggatacgaattcaggatgaaagacttcaactttatcacaagtaatccgtggaaagattcgacaggcgaggaggacgtcacgtttaagatccggcatacaccggagtttatcaaaggccgtttgatacaggatgcagacggttaccggattatctcttccgagaaattacagggaattgctccgggacagttcggggtgatttatgatgccgaatccagaatttgtttcgggagtggtgaaataggatgatgcctcgcccgaaaatctttctttcgttttttcaaatataatattccgccaagtcaacaatgcctgcccgcatggcatatttgatggcctcgtgcacattgttcactcccagtttacggaatatattctttcggtgactgttgatggtatggaagctcagattcttctctgcggctatctctttggtcgtttttcccaaagctatttctttcaggattattttttctgtcggtgtaagcaggcggtcttcctgcggcacgaaagtatgcacggatgaaacagtgtttgtatttccgcttcccgataacagcagattgcttacgtgattgcagataaagcgttctttgcgtgatgcgcattgcagagccgacataatttcttctttggagttatctttcaacactactccgaacgcatggctgctgaacaagacctgcctcaggaatccgatactcaattcgtcggagaacaagagccagtccgactctttgaatcgttcctgaaggataatcagttcatccgcaccggaaaaatcgaacaatgtataatctaaaataaccaccgcttgcggatgaatgcgtaatagctgaaccaactctattttattgtcggcttccagcaacaggcttacttctttctgcttgcttaacaaaaacatcattcctgctttcgtgatgtcctggttatctgcgatgatatattctctcataatctatccataaaaaaactccgttgcaaatgtacactttttgtgcgatttgcaacggagttatgtgaattagttacgagtagagggccactcgttacttttattaccatgaacggcctttaaatacatccgactgactcagcggaacgaggttaccgctcagagttaatgtattggagttgaagttcgggttaatggttacagtagcgttatttccaccgttggtcaatgtgataaatacctgagccgagataccgataccctgtacgctgaagttacagtttacgtttcctcttttatcggtagtcacttttacgtccgaagtagttccatccacagttacaccaccaattccgttagggccggggtacggagtgttgaatgccacctgcacagttgctctctgtccattcagcatcacaaagttagtgtttgacgacacgaaagcggtctggccacgtttgaaaatcacttggtcggcttccagtacaaactgtttgtctttgatagcttgtacggcttgttgatacgctacttggtcggcagcctgttcttcggctttcagtctggctctttcggcgtctctttgtgccttgcggtctgcccggcgcacctccctgttagactcttgtgcatacatcatggtcgatgcacttactaataccaatgctactaatgcaataaactttttcataacttttttttgtttaggtttaaaactgttgttcgtttattccaagaacaactcccttttcagattgttcacttgcgtctcacaattttatatccgatagcggcaatcgtaatgctcattaacggactgataatgttgaagaagcaataaggaagataaaccagtgtcggaacacttaatatcgtggcctgtgtcattccgcaggtattccatggtatcaagacggaagttactgtaacagaatcttccgtagtccggctgagcagacagctttcataacctttcttttcatatatatcccggaacatgtttccggtcaggataatgctgatatattggtcggctgtggcgaggttcaggaagatacccgaacagaccgtagaagccaccatgctaaccgtatttttcatgaagcggacaaatacggaagtgatacttcccaacattccgctggcagtcatggctcctccgaagcacatggcacagatgataagccataccgtattcatcatgcccgccatgccgcgggtggccacaagttcggtgagcgcttcgttgcttgtctgtaggctggttcctccataaagggtcatcatcaatcctttaaagatggactgaataccttcggaattctgagcaccggatatttcttgcaacagatcgggttggaagaataccgcaaatactcctgccaatgctgccgacaagaacaaggtgataatggaaggtacccgacgggcaatcagtatgcctgttcctatcggtacaatcagcaaccatggcgtaatgtggaattttcctgccagtgctgccgagaactctgctatatgttctgtatttccggcattgtgtgacagcccggctacagtgaagattatcaaggtgatgattaatgatggcacagtggttatcagcatatagcggatgtgcttgaacaggggggtgtcggtaaccgaggcggctaatatcgtagtatccgataatggtgagattttatctccgaagtaagctcccgaaataatagctccggcgatccatccttcttcaaaaccttgtgctttcccgattcccatcagggcgatcccgatggtggcaatcgtggtccaggaacttccggtcataaccgataccaatgcgcaaataatgcaggtagaggtcaggaaaaaactgggatgaatgatttgtatgccgtaataaatcagtgtcggaactacgccactgatcatccacgcaccactcagggcgccaataattaagaggataatcagtgcagaagatacaccggtaatattgttcgtaatagccagttcaaagtctttccatcctatcttgtagaatcccatgccgatcagtacacaaacagctgttgtggtcaggagggacacctggctgcctccgctgagtgcatcgctgccaaatgtgcgtatggtggcaaatagcagggcaaccagtacgatcaaggggatcaacgagacaaggggcgaggggatttttttcatgattcttcttttccttttttattttcaagcatctattcctgtaaatgttttcagtgcgtaacctatcaggaagctgataccggctacactgaaactgagtaccaccatttcggtaaatcttttgcggaagctctctccgcgtgccacggaatagtagtaattgaacaatgcgatgatcattaaagccatggccaacattacccctaaagctatcagtacgttttcaatcaggatgaacggagcaaccagtgccgccaccgtgatgatataggcgattcccgtatagatagctgctttcaccgggtgtttgttttctccgccttccgatttggtcgagaggtattcggacgaagccattgataaagctgccgctattccggtgatgcttccggttagggcaatcagcctggagtcgcttaatgccaaagtgaaaccggccagtgctccggtaaactctaccaaggcatcatttaggccgagtactaccgatcccatatattcaagccgctcttcgttgatcagtccgattagtttctgttcgtggatttcctcttctttggccaactgctggagatccggaaaatcggtatatttggcataatcatgatgtgcgttctcctcgctcgattccatcagcttaattgcaaatgtaatacccaggacccgtgccaaccagtagtatttggctatacgcatccggtcgggtgctacatcggttcctgtatacttcttcagtgtggcataatgtgccttttcttctgctgaaatcaggcgtaatactctgcggttcgattcgtctttttcaatagaggccagccgttcgtatacgatgctttcggttttttcgtttctttggaaacggataaactcttcattcatttctttattcaggttcgttttcataactcttaattttgcaagatatcctgtcttctgcaccaccaatagcggataaataatatccctgtgaacataagtgccagtgagagtccggtgtagaaaaccgagatgaacgtgtcgggtaacagatgtagcgaacgaatggtaattcccatcgctatcatgaagcacatgacaatccagccctttgcgtcaaaaaaagagaaggggcaattcttttcctttttcttttgttcgatccggcgggtatgtttatagtagagctttcggaagacgagaataaaaaacaataggaagacgaccgtagcttcgcctaccttgaagtgccagtggcgtgagtcattgagccaggtcacaatacctatacgcaggagattggcccccgctattatccaaacgataccggctgtgattaataatacttgtctgtttactccgtacttcatgtctatataacaattattaggtgacttcggattattgttttgagaaaaaagtaatcagcagtgaaccgatggtcaatgctattcccgtaccaacaactccatgccaaccgaatgcctgccagaatgttcctgccagaaacgtccccgtagaggcacctatgaagtaagtggtcataaaaatcgtattaatgcggttagaagcactcggacagagttcgaagatgcgggtctggttgcttaattggatacattgcatacctatatcgatgataatgatgccggcaactataccccaataagagttttcccctgcaaacagcaggaaccaagccaataaaatcagtccgcatccgatgaaattgaatcgtctgaccccgactctccgtacatactttcctacgagggaagctgacaaagcaccggcaatgccacacaaccctaacataccgatgacatggctgtcggcatagaacggggcacctcccatcttaaatgccagacacgaccacatagccagaaatgaaccgaaagcaagtgctgcacggacagagaaaatgcgaagttcgggatattgcttcaataatgaatacaaagacttcattaagtcgctataccttccctgaaagttagggcgtatgtccggcaatacccgcatgaccacgatgccacataacagcatcatacctgcggcgatataatacatttcgcgccagccaaacagttctcctataaatccgctgaccactcgtgaagccaagatgccggtcagtaatcccgaaactacgatccctacgttccgtcccttgttttccggacgcgagaactgagaggctatcgggataaatatttgtggcatcaccgaacagatacctgtgagaagcgaagcacaaagaatgatatggatgttgggagccattgcgatgacgagcaacgagagaatcaatacggagaaactggtaagaatgatacgtttccgctggtataagtcacctaaaggaacgataaacaataatccgagcgcataaccgatttgtgtcaccatggcgatcagattggttttaaactccgaaacgcccagttcatgacgaatcatgttcagtaagggctggttatagtaaaggttggctaccgatatgcctgcaacaatggcgagtgtccaaagtatcgaagccggtaatccaccattttctttcaaaatctgtttcatggcgcaaagttaccattttgggggctattccacaaagaacgttgttgaaattgtatttccttcgtcgtctactgctgtcagcgagtgctttcccggagcagggcgtagagagaatttatggaagtcctgtgtctgcatcaggtaggtttcgtccagatgccagtagacagttgtgttgggatggctgtggaccaattcgacggtcagctgtccttggttgccatccatctgtttaggcagatggatccgcgctcccatcggaggatagataaactgcatcggttggaaacggtcttctccgcatccggatttgaagggagggagcggatgatactcaggatgatgctgtttataataccactcccatacgggtggaagggtaaaccagtttcggcggacaaccggttcactgtcagcacagttttcatagatacggaaccgttcgtctgctgatagggtgaccgggtggtgataggggcaggcttccgttctgaggccttccggaagaattagcagggtatctgtttcttcacaaaaccgtcctttcaaatgtccggattgccgacagatctctgcttcaaccagtttaccttgtggccgctcgaaccagggagaggatgggagcagattgaatacatcgaacaggacaggccccgctgtacgggcccctaccagtccgggcttgccttcacccgtagcatttccgacccatacacctacggcatatttgggagttacccccactgcccaggcatcccggaaaccataactggtacccgttttccaagcaatggtttgcatggaaggaatggtacgccagtctatctcttcggggcggtttacttctttgatggcgtcaaatgtttgccagactgctccgggctggaatggcggatgttgaatgatggccggggatcggtgggcggagagggagtccgataataataaggtacaaggggtctgtaccagtccgttgaggctgcgtcccatattggcataggccgaagtgacatcccaaagggtagcttccgctcctcccagaatcaaagaaagtccgtagtgtcctgagggacggtttaaggtggtcagccctatctgcttcagaaaattgtggaacttgggtactccataccgttgtaacatagtgaccgaaggaatgttgagcgaacgtgcgatagcttctgaagccggtacggcaccttcgaattgctggttgaaattttgtggagtaaagccattaatgttgaccggaacgtccggtaacagagtattgggaagaatctctccttcctgtagcattgcataataaagaaaaggcttgagaatgcttcctgtgctgcgtgctgaccggattacatctacctggttacccctttttttcttgtcgaagtgtacattgccgcaataagcaatggcctgattggtacgaatgtcaattacgaggatggccatatttcggatatcacttcgcttgaattcgctgttccaccgttctaccagactttctatctgagtttgtatacccttgtcgatggtcgatacggaatattctccatttcgggtctgatagaaatggtctgtcagatggggggctatctgtggaagaggcaaaggttcctggggaagtggctcgctgatagccagttcgtaagtggaagtatcgagaatacctttttggtgcaggtgtgtcagcagtcggtttcgtttgtcaagtaatgcttgccggcttttcgaaaggtggatcatggcgggagagttgggaagtacggcaagcatagccgattccgcccaggacagttcttctgccgagtgtccgaaatagcgccatgcagcagcatccagtcccactacattacctccgaagggggcatgcgaaacataaagtgacaatatcttcttcttggaataacggaactccagccgggtggctcctatcatctcgatcagtttttccttgaatgtacgcggcttgttccgtgccagccgaatcgtttgcatcgtaagagtgcttcccccgctgacgattcgcttgtgtctgagattttgcagggcggctctgcctattgccaaggggttgactccccaatggcggtagaattggcggtcttcaaattcaaccagacaggtagctactttttccggagtgtggtcgcgcggaggaaaacgccattgtccatccgtggcgatacgggcaccgagaagttctccattacggtcgaccaagacagtagaatagggagaggtgaataattgccggggaagacaaaataagtataggagaagtaggaggaagagggaaattttccaccaacttttgaaatatttcttccaccccctcccttgtggggaggggggaagattgtctggtttaagaatacggttcatcaggttttatttgatcgttttacctgatgacttgtgtccttccggcctgtgtctttgcctgtgcattagcatcatacatcgcttcacactggatagccggcataacaaaatcaccggcataggtcgcctgtaagcggacggtaaatgttttggcttgtccctgccgtaagttaaagtaggtcagtatccggtcatcgcgaatatcctgatagctataaggagcagaggttgtaatctgtcctgccattcgttcattaaagatctcccagccggcaggaatgatatgtgtcagtgccagattcgtataatccgtcgtaccactgatgttggctacagttaccactgccataaagtccgtaccctgattcagagaacgtgtatctatcggcgagccgttattgtctaaataccttacgttcaggcgtagattattggccatcggcggcaatgtgtcgttcagtaattgggtacgtgtgatcagatctgcgtttagagaccctttcccgttatttttcaggattacttttccttcatgtggtgaagtggggagtgatgcctcgtatatggctttggctgattttacagccggttgctgtttgccattcaacgtccagttaaagtccagcgtaccggacagtttttctgccaaacgtcccattgccatcaatgaaaaggcagtagactgtgtgctgaaccatgtctcttgtgccaggttgtgtgaaacgattttggcttgttccatggcctcacgctggcggttcatcagcaataaggtttcaagtatcattgcttcgtcacgatcggatgaaccgtatacatagttattcgatgaataaggttctacggttgtcttagcactgaataccagttcaccggctgctttctctttgccgttgagtgcataggcggctgccaaacgccatttggcttgttgcgagagtgccggcaattctttcatccggttcatggctccatgttcaggcgatcccgccatagccagtgtgtaaaggcggaaagcctgctggaggtctgcctgccaataccaccagttctgctcttgtgtgacgggttgccaattctgggatgctgccttttggaagcgtttccatttgttcaatacattgctgttcactgcataacccttttcttgtgccaataccaggaacatacctgcataagaggtgatccattcgtttgccgaggcatctcccggccaatagacgaaacctccgttgggaagttgacgcccgtatagttgacggatagcttcctgtacattggtttttatcttttccgattcctcgttgtctactgttttgaactggctgacgaacagcagcggaagggcttttgaagtcagttgctctgtacagttgtgctgataattgtataggaaatcgaaacggcggcttatgtcgacagacgggatgcgtgagacctccaactgtatactgtttccttccgaaccgttacttaactggtaatggagctcttcactctttccggcttccacccatttactctcacgcaaagtgactaccggattcggattacgtacctctatctcgattgtttctttggtactttgtccgttaccgttagcagccagatggatggtagctttcccggttttcgtacttgtctttaatttaaagaagataagccggtcaccggtttggttgaaagtaagcgtctgctgcttgctgccgttcacttgtactccggcaccggaagcctgtatggatacgtttacattcttcacactgttttccaatgcgaatacgttaacaggaacttcaatctcttcaccggtactcagtacacgtggcagtgtcgaaagaatcattaacggagtgcgtacaggagctgttttttctgcatttccgtatgctccgtcctgaccggccactaccatggcacgtacggaacctacatacatcggtaaagtaatctggtgagtgcggctttttcctttggcaatactgaaaggaccgatgaatttcactaccggcttgaagcggtttgctttctggtccgatggcttcagggtttcatcaccgcctgtgctgaacatcgatccatagcttcccgctgtggctcccagtacatcgtcatacatatcccaagtacggattcccagtgcctcacgggcatagaaactgttccagggatctggtgtcttgaagttggttaaatcaagcagcccgtcatctacaatagcgagcgtataagtcatcggtttaccgtgcttttcgcttacggtcaggttgaatgcctgttcgggacgaagcacttccggcatcttgatttgtggctcaagaactgtttgcttatcagttacgaataccggcattataccgtacatgcggatagggaggtcgtttaccgtttgcgcatggggttgcagcaggctgatatgaagataaacattcggagccatttcgggagtcaccttaaactgatatttggtgtcctccttccccgatacttcaatccactcccgttgaattacggacgaaccgttttcaagtgttaccagtgctcttcctcctgcggaagccggcaatatggctgttacggtttctcccggttcgtaggagtccttgtcaatggagaaagataacatcttgataccactcgggtcactcttgttggaacgtccccgccagtcaggccagtccacatagatggtacctcccgtagcatgtccgctttcgcggtctttcacgtaaaccagataccgtccccaatccggataattcactctgaagctgaattgtccctttccgcctactgtgttgagtcgtcctgtagctacggggctgatggagctgctgttgatgtatgtttcgaatgattcgttatcgttttcccaccaccaactccaactgatgcggtatattttgtattccagcccggaacggttcaccggttttccgtcgggactgactgtaatgacatcaaacacatgatctttatctgtttcgatatatctgccctgcggttggttcaggttgatacctacgtatgacgggaaaggagagtaggggacagactgagtttggatactggcatctccacccggctcgaatacctgagtcgtgatgttggcttgaagcatgcccggggcattttccgaggcaggaagtttcagcatgaatccggcattgccactttcgtccagtgtaccattgaatacatcggttcttaccgaggtgaattccgtagccggattattgaaaatgtaagttccataattcttgaattgggtgttgactttcgataaagacatttctacctttgccttcaggcgtgatgcagtggctcctgtcagccatgctgacgaaagatgtgcctgtacttctttatctgaagctttcaggatttctcccggcaatttcaggtttattttcaggcggttcggcttgatggtttctacccgaagcgctttgtgaaaggcggtacctcccacctttatgtacgcattccatagtccggttgggtcttctgcctgcgtcgggatcttgaatgtatagaatccattcagtccgttggttgaaataagtttgctataaaattgcccccttggattatagagttccaatgctacaggatgtttgtccggaatacgtttggtacgatcttccagaataaacgagatatgcagagtgtctcccggacgccatactcctctttcaccgtacacaaatcctttcaagcctttttggatatccttgccgcccacatcaaagcggctggtggactgttcttctccgtctgctacttttacgtaggctttttgcttgtctgattccgctactacgatgaaaggcactcctttcgtttcaattgtggcgaaaccttccgaatccgtcactgctttgcctacaggctgtaactggaaattgtaaacagtgacttgggctttttccaccggtttggtatccaggatgttgtttactgctatccaaagtttattcattgaattgcgtttcacaatcatgccgatgttggaagccagcacattacaggtggctatccggtcagatgtcatgtaataagacgggtgacaagggttgtcccgttcatcccatcggtactgactccagtcggcattttcatttccgctgaaataataatatgtttcgggtttgtcccagactgcttcatcttcttccggaagagtgccggatgtgactttggtcaaagattcggtttcctcggaaaattgcattctcgggctttcaccaccaccacaagggtaggccgaatactcctgtttgaacgaaaggatgacacgataaatagcacccggttcctgatggatcagacctgccaggtcaatagaatagttttcccatttatgaaggtcttttgatgaatctttgcctaaaaacaatgtttttttgtaaaccagtcttccggatcttcttaattcattggccgaagaaagcgaattgttttgcatgaacatcagtacattgttttcgaagatgcggataacccgcaaatctactgcatacaggttgacggcccggaacggaatgacaaggttttttgagtcgggaatgatggcacctgcagaggctatttctacctgaggtttcagactcagttcgccgaaagagatagagtgtgagtttcccagtgcttttccttggctgttttttatgccttcgtgtattttcagtgtaagcttgctgagctgactggcttcaaaataaacattcacacggttatccgttacctgaaagatatacgaagaaatctccggtatttcgatcagtccttttaaatcctgagcatccgaaaccgggtctgagaagacgatttgtattccgttttccggttggtcgatacgttcggcagaaaggaagcggaaactgtctttggcaggaatagtgattgtttcactttgcgtccggtcaattccggcggactttccgtctgctgtgatttcaagttcgtagtcttgtttatttctttggatattgccgatgacgaagctataggctgacggattggaggtggactctacggtgactgtcggagaagacagcccgccactggcagaaagcattttttctacctgctccttagtcgttttatcgctgaaacggatctctcctttcacagttactttatcgggtgaagaggcggttatttcaagcggagctgtatgtaatgtgaaattgctttcctgtacccggaaggagaagtcgaatgatttcaatttgctatccacttcaacgaaatttcccagctggaatgttccctggtacagttctcccggtttcagttgtccctcttccggaagaaactcgacagtattattactgacccaataggccttcccttttatcgaaggagtgaagcggaacggattatccttcagttcattgtttaagtccaccatcggctggtcctgcgtcaactcaatccgtatgggagaagattgagaaatgacaccgcccgtataggcattgacgtaaggagcgtattccgaagacggaataatttctttagcgctgcgtgtgcaagcgaataatcctgcgatgatgatcataaacacacaggagaatagaattaaaagattctttttccctttcataatgaatcatgtttagttagttattattttatcgtccgttcgtttttatctctactttcaagatatggatttacaaagatacaatttatccgatagaaagtgtcgcgaggctctgttttttggtttgcccggcagatgtgtagcttacgtcatctatagtgagggcatgtggcgcttcggatgtagtcatcatttacacaccgaggtaaatgcttttacatgtgtcggtaagggcttggtaaatgtaatcagttgatttttagttgatatctttgggggagattcggataatcattacccgctttgtgttgttgcttactttaaaccgattgtccgttcgttctcctatcaaccaggcaattcgttctccgcaacacaacacccattgtttcttcttgtcactcagggagaacttccggtccgtcaaatagtcgcttacacgctttttgcctatcattccaaaaggaataaacacatcaccttgtttccattttcttatacaccatgctgcatccatcttgtctgcatcaaagcaagctgtttttttatctttgggaattataaattcaggagtataatcatatacttccgtaaccagacggaaaggtggtttggcttcttcctcctttatatcttcttcaattagcagcaattccctgtcttttatgactttccaccctttaccgatgaagacttttcccggctgtccgtcgagtgattgctgtatactttctatttgggcggcgttgaaaccgagcggatgcaacagttcgaagaggatggctcccggtaccggttcttgcagtaaagcctctatccggataccttcggaggtcagcacgcgtgtccgtgcttcttctatacctttattgtatagagttgccgtgtcattcaggtagttagtcgtgcggataatgctctctttaaccgatggattgatttcctgcatcagaggtaacaggttcaaacgaattttattccgggtataatcatccaaaagattggtactgtccgttacgtaatcctgattcatgcgttgcaggtatgcgattatttcatcgcggctcaggcaaagcaaagggcgtacgatgtttccgttctttggacggattccgagcagtccgttaatgccggtaccccggatcagattcagtaatacggtctctacgctgtcgtctttatggtgagctactgcgataacagctgctccacgctgtttcctgagcgtttcgaaccactcgtagcgtaattcacgggcagccatctcgatagaaatgtgtttgtcggcggcatattgaattgtatcaaaatgtacggtatgtaaaggtacttccgcttcatggcacaaccggcgtacaaatgcttcatctctgtccgattctttatcccgcagatggaaattgcaatgggtagcttcacaggtgtaccccattgatagcaacaatcgtagcaaagccacagaatcggctccgccgcttagtgctaccaataccttgtcattcagataaaagagcttctctttttcgatgtattgtgctattctatgttgtatcatattgcaaagataatagttttgtcaatatggataagaattctcccttatttaaaaacaatctaaataatttgcatgccacaaagttatgaattatctttgcgccaaaattagaggtacacacactatgcgattgtccgaattaaaaacaggtgagaagggagtcatagtcaaagtgctgggacacggcggcttccgtaaacggattgtggagatgggttttatcaagggaaaaaccgtagaagtattgcttaatgctccactgaaagacccgatcaaatacaaaataatgggttatgaaatctctctgcggcgacaggaggctgatatgatcgagatcatcagcgagcaggaggctaagttacaaacacaggaatctgcttatcatcagggattgactgaagatattgacgtaaaagaggaagatttgaagcgggttgcccttggaaaacggcgtacgataaatgtggcgctggtcggtaatccgaactgtggtaagacttctcttttcaatctggcttcaggagcccacgaacatgtaggcaattatagcggtgtgaccgtagatgccaaagaaggatattttgatttccagggttatcacttcaagatagtcgacttgcccggtacttactctctgtcagcttatactcccgaagaaatttatgtccgccgccacatcattgatgaaacgccggatgtgatcattaatgtggtcgattcttccaacctggagcgtaatctctatcttactacccagcttatcgatatgaatgtacgcatggtggtagccctcaatatgtacgatgaactggaagccagcggtaatacccttgatcaccgcctgttgggtaatttgttcggtgttccgatggtacctactgtttgcaagaaaaatatcggagtagaccgtcttttccatgtcgttatcaatctctacgaaggtgccgactttattgataaaaaagggcatatccatccggaagtggctaaggaaatcatggattggcatcagaccctgcctaactttaaggatcacggtgaacatcctgccgactatacccatggtaaagaaccggtgggcaaagtattccgccatattcatatcaatcatggtcccgatttggagaaggctatcgatgcggtgaaagaagaaatctcaaagaacgaatttatccgccataaatattctacccgttatctggctatcaaattactggagaatgatcctgaaatagaacgcttcattcatactctgcccaatgccgcagaggtggaaaagaaacgggataaagcggcccggcgtatacaggagacaatgaacgaagatagcgaatctgctttgacagatgctaaatatggttttatcagtggagcgttgaaagaaacttttaccgacaatcatctggagcaggaacagacaacgaaggtgctcgactccattgtgacccatcgcatttggggatatcccattttcttcctttttatgtatctgatgttcgagggtacgtttgtaattggggagtacccgatgatgggtatcgagtggcttgtcgaggtgatgggtaacctgattcgggataacatgtccgagggcccgctgaaggatatgatgattgatggtatcattggtggagtcggaggagtgattgtatttctgcccaacatcctgatattgtatttctgcatttccttgatggaagattcgggttatatggcccgtgccgcatttattatggataaaatcatgcataagatgggcttgcacggtaagtcgttcattcctttgataatgggtttcgggtgtaatgtgcctgcaataatggcttcacgtaccattgagaaccggaagagccgtctgatcaccatgctcgtcaatccgttgatgtcgtgcagtgcccgtctgcctatctacctggtattggtgggtgctttctttcctaataatggcagtttggttttattgggaatttatgttatcggaatcgcattggcggttgttatggctcgtttgttcagccgttttctggtgaagggagatgatactccgttcgtgatggaacttccaccttaccgcatgccgactatgaagtctatcttccggcatacatgggaaaaaggcgcgcaatacctcaaaaagatgggaggtatcattatgattgcttccattatcatttggtttttgggctattatccggatcataatgcttatcctacccaggcggaacagcaggaaaactcttatatcgggcagataggtcaggcagtggagcctgtacttgaaccgttaggattcgattggaagctgagtatcggtcttctttccggtgtgggtgccaaggagttggtagtaagtacgctcggtgtactttatacaaatgatgccgatgccgatgcggtcagtctggccgaacggattccgatcactccgcttgcatcgttcagctatatgctgtttgtgctgatctacttcccgtgcattgccacgttggtggccatcaagcaagagtccggtagttggaagtgggctatctttacggcaggatataccacagcattggcatggattgtttcatttgccgtttatcagataggaggattgtttttatgaattggcaagaatgggttgtcgggttactgattatattgtgtgtagcccgcatcctctatggtatttatgttttttttcgtcgtgtgaaagaaaatgataacccttgtgcaagttgtgcaagtggctgtgaattaaaggatatgatggataagaagcggaaagagtgttcgtctaagaaaaaaaagacaaagaaaaattgctgcggatagtttggtagtttcaaaatttgtactacctttgcaaccgcaaacgagaaacaaggttccttggatgagtggcttagtcagcggtctgcaaaaccgtgtacggcggttcgaatccgccaggaacctcgaatattactttaaatcccttgaaagtcaagtgctttcaagggatttttctttgttggattccaatctggggaccaataaattcattctttccacactattgcagcaaaaaatattagggagcaagttgcagaattgataataggacacaatcctccaaatccatatacaagccatttgagcatatccgacagatgaggattccatatttccgtataatatgccgtaagacatataaaaatgcagtacatagtagagtgtattgcatttttcttatatttgcaagtactttcatgaaaggtaaaaaagaccataaaaaaaatgaaaacgaaaaagttatcaaaactactactgttgttcttgtgcacaattaatcttattggttgcaacaatgaagaaacggaatctgcctaccatttggagttgactgtaaattcatgcaaaatcatattgggcggtagtgaatctgtaaagctgacggcccatgaaaacacgacattggatataactgatggtgaagtggctgatgctgtttatacatggggtggaaatacggaagcctctgatatcaaaattacaggtaagcgggatggagaaaccgatattatcgttaccgatcatgaaacaggagagactgccacgataaaagtggaagtgaccaaagcgccgatgcctcaccttgcacttaaaaaagggaataggaaaaatgtttttgaccgtatagatttttatctaacaaatgatggttcgcaatctataacgatgggattactgtcagaggtatgcgattcaatagtctggacagtgaatggacagaaaggcagctatcggttgtatgactgtgaaagtggagaaggagtagttaagagccatttggttatggagtgggggcactgctttatattccccggagattatgaaacttgccttacagcatggaaggataacaaggtgctttaccaagacatactttcggttactatcattaatgataaagattttctgggatttaattggaaggatgtgactaatacttcacaggcgtggacttcttatgccgatgttattggcagtaaccctgatttgatgactacttatcggtttaatgctggtgtcccatcagtggaagttgcatactttaatgttacaagcgataaatatctgagccaaagttatgatgtgctttataactacttctgtttactctattcgcaacctacttacgaagataaaaaggataagcaaaagatctttcgattatataaggaactgttttccgagcaaaaggtatatccgaatgcctatccgtgcgctatatgggttacagataacgccaatgcggttttattacttgacgaagacgattcggcacgctatatcgtttatgcagaaccaagacagtgataaaattattttttatgaaggaagccctcagtgaagtttcttcatttaaattcactacattggtgctttgtgatttattaataatagtcataaagtagcactatcccggtcagttggttgataatatctaaatttaaagtgagggtgcgtatggatactgattttgtaaatttgacaacagaaaaccttgccggtgagcatttatgttgcattatccgcagtaaaaagccacatcagggtattgaagcaaagcggcgatggctttctgaccggctgaatgaaggtcacgtctttagaaaattgaatgcaaaggctacggtttttatcgaatatgctccccttgaaacagcttgggtccccataaccggtgataactattattacgtatattgcttatgggttttaggtagttacaaaggaaaagggtatgcaaagtcattgatggagtattgtttggctgatgccaaagcaaagggtaaatccggtatttgtatgctgggagcaaaaaaacaaaaatcctggctttctgaccaatcatttgcgaagaagttcggttttgaagttgttgatactactgataacggatatgaattgcttgcgctttcttttgacggaacaataccccggtttgcgcaaaatgtaaagaagcaggagattgaaagcaacgaactgacgatttactatgatatgcaatgtccttatatctgtcaaaacattgaaataataaaacagtattgcgaaatgaatgacgttcccgtatctttcattcaagtggatacgttacaaaaagcaaaggaattgccctgcgttttcaataactgggctgtattctataaaggaaagtttgagactgtgaatttattgttggatgtcgactacttaaagaggatactcaaaaagtgaaaatgtaaattcggatatgctttgtgagctttgctgtctgaattcatattgaatattatataaccctaaggtgtcaatcatattttaaatgaagatgcgtcgaaaatgtcaattccgcatggagacattctcgacacaccttcattgattttatctatctttacttcagaataaagatatagcctttgtctttcggtattttgattttatctttggctgacagtgtgaatccttcctggaaacctttgatagcaggtgccgtcagttttgccttgtcggggtctatccccagtttctcccagtcaatttgtagtttcacctcactgtctttctttgcccagctggcaatggctatcatcactttgccatctttgacaaacgaagtggccagaatatcgctgcgtcctgttttcaccggattgtatgatacccaataccccatcatccggctgtccttgataccgaaagcatcccataccttccagagttgtgaagggacggactccatcggttcgcgtgctgtcatgccgtatagcataccccggtaaggattgccaccgtcctgtaacatttcgctcatcatgccgaaggggatacccgaaacatctgtcagccagtattccggtgatttttcgtatttgaagtattcgccgaaccaaagacggtccaggtaaggcatgtgttccatgtacaggaagatgctgttgatgtacccgtccgccggattgaactggttggcggaatgaacgtcgatgcgcgggtcgggacgattgttttccagtacccggcggatacgtttcatggtgttgcggtcgaaagccaggtcgtcgatatatacaccgtcgatacctacattctttgtcagccagttcagcccttccacgtaaaaattatgccagcgtgaaatgccggtattcacgatggctgcatctttgtaggcatctacaaaccatgcggcgatgtagtcaccgtccagatgctcttgcaaccatgcatatcctcctcctttacccggagagaagatctcgtgtccgagacttttcagggcaaaaagctccggtgcgtgattgttcagctcccttacggtgtagtagattttcactttgtaacctttggcatgcgattcgtccacgtactgcttcatgaaggccggacggaaaaacggatagttgatatgcgggttgactgcattgccgtgatgcaggttgatgacgttcgctccggtttcagctactacgtctaccgcctgataagcatgcgcatcaccctctttcagtttttcggcaggctggtaaccgtgatagtagcgatcggtccactgcttcatggtgtctatcggtttgaaaggtgtcaccagcaccaggaagtcgaaattcagttcttctcctttggtcatggtccgctttccgctgtaggtttcgacatccacttgcttcccttgttcccggtagctgatacctcctttgccgtcgttgaaccaggatggcggcatgttcagcggttgcattttgtagaaattggtgttcagcgggcggcggtagttttccgcacggaacaggcattgcattccaccgtttacgtcgccgaaccagaaaccttcctgattgcgttccacattccatttccatcggtcgcttttaggacgcagagaaccttcatatcccattcccaaacgatatttggcagtcgttgccggcatggaagtcatcagagctatgtcatctaccgatgtgttttcggttgcttttactttaatctgataactcatgaaaccgtcaaactccatgctggcatgtaccgtcacatcgagtgatccggccttcccggcagctgtccaactaacaattccgtcttccttcttgccgaatttcaatggtgaagtgatggtgacgggcagttgttttccattccggcggatgacgagctccatcggttttgccaggatgtctttggcttctttgccaacggaggtcatctcttcggtgaaataactccggatggaagccggtaaccccagttcgccggcagtgacgcttcgtcccaatacgctgattgtgttgtctgtcaccgtcatcggaatgaacggcttcaccagttggtcatttacggcatattgtgaattcagccagcgcaggcgtgacaaacgccacaaatcactgtctcctttgtctaccaacacattgtcggacaggttgatcgtgatctttacctcttgagaggctcccgatgaatcgctgacaatggctttaccgctataaatgcctctgccggcatgttccggcatctgaatgcctatccaaagcggctgtacacgccccttgcccacgtttacttccggatgcatcgggcgccctatccagtcggtcccttccgtattgaaacaagtgatggccgatgccggaatcatcccgtctttacctttcaggtcggtgaaggttactttgaccccgttcaccggattcttgaaagcccatagtccgagttgcaatacataatattcgtttaagtctgcttcaccaaaaaattcgccggtggctccttgggttacctgacggtacgagagatcgtcgaacatacggatagggaacttacggtcttcgggcagcagcaggaacggtttattgctattggcttctgccaatgcctgtttctcttttgctgtggcaatgatttccatcggatagaagctgttgaaactgcctaacgactcgaatctgaccagtttggcccgggtcacctttgttcctggagtggaactgcagattgctttccattgtgcgtcggctctgtcaggttgcttcggatagttcactttggggtatggacctcccgatgtatggtagggcagatagtatacatagtaattccctgtacctgtactggcatcgaaccggatacgtccgtactcacggttgatttccaccggaagtacattgtccactactttgccggtagaagcatttatcacaataatccctttctgttcgggattggcgtcgcgtctgcgccaggggatataagcttccgctacggtggcgggagtattcattgaaacaacggcacggtgattacccagtgtgtcgggagtccagtagttttcgccgtaaaacgaagcttcggggacgaagtcctgagcagctgccggaaaggttaacaaggctgacagtgcccataaaaagagttttttcataatgttttgtctaataaataagtatgtgcaaatttacaaagaatcgtttgggatcggataagatttgcctgtttttatttgagatgcggtttctctgtcgattggcggacagtatttggacacctttatttgcattttccctttttgtattatctttgcgccctcaaaaaacaaataaaccctacactatgaacaaaaagaaagttttaggtatttcgcttctggcactctctctgtttgcttgccaggatgatgataccgtcgacattctcaatgcctttggcacaccgcctgccttgactaaaatttcggcagaggagtttctcaatcagggagaacagatgtttgaagatggtgagagcgttgatgacattgtttcggccgatcgtgccttctatgtgaaccaaccgcttaatgtatcgatgacagacggaaagctccgcctgttcaatggtatggctcacgattttaaagaagtctccgtatggcttacgatgccccatttgcgtgataccatccatctgatgcagtttgaagaagttccgggcttttacaacatccggttggattctccgctgaagatgggcgaggcagtctatccctccaaaagcggcaagcctgtccgtgtcaacaatctggctttgctttctcccgatcagtacgaactgttgcttacatgcaacgattctgtattcgatatgttgaaaaccatcaagatgaagacccgcattcagatgggaaaatacggtagtggtaactggggagtgatgacgcccaatgcagcccgttattatgccacttcagcggtaaatatggccgttatgttcagttccggaatttttcgtgattcattgatgaattataaaggtagcatccataacgatgcagggaaggagattgaccgtgagggattgttgaaatccattctgaataagcaaagtctggtgttcggagtagtcaccgggcccggaatcgccggacttggcggaggaaacgcactgggattgcgtgaggaatatctttcgggcttcttttaccagaaccgggtagcgatagattgcaattgggtgcttcatgtctggattcacgaattgggacactgtctgggctacggccattccagcagcttgtgttatggatcgatgcccgacgagattgtgccgaaagtatatcgttacatgatgaaacaccggatgttgccttatgtcatcaatccattcaagagttacaatgattataaccccggtatcaacgatgccgataatcccgacatagagttatgatgaaaagatacagcatttttatggtagtggcgactttgctgctcacttttgccgcatgtgataaaaacaatatgccggggttcggtttcactaccgattccatccttacactgacttttgagaaagagctggatgcggcagccatcggtgtaggtacacagagctataatcctgtgggaatgcgccgttcgggtgataccctttttatagccaaccgtgccgacggatcggatggtgtccggattgttcgtgcctccaccggcgaattgctttactcgttgacaggttggacgtatgacggaaaagctgaaaagttcgataatcaagtgatggatgtagccgtcaacagcgattatatttttgtggtgaaccgctcttcccggatcgacatgtttcgccggaacgattatacgtatgtaaccactatcgggcgtacaggttggcagtcgagctcgttgttgcaatgcgagtctgccgaagtagccggtgacaaactatttattcgtgataaacaaaaaatcaaggtggtacagctttcggactgtacaccggaaaatcgtttcaaggtccccgtgtttgcccagaacaccgacagcacaacttccaacaatggatttaacctcgagaccgtggcacgttacaaggaacttatttacgtatcggactatgaaagttcgcgtatcctcgtaatcgatccctccaccgttactacgaaaggagagccggtccgctttgtccgttcctaccgtatgcaaagcaagccgttgagtatgggattctttcaggatgaaatgtacgttgtctgtgccaataaccgtatcgtaagagtgaatctcctcaccggagaggagaaggacgcttactcttcttttgccggaggaatgggattcggtactccgggacgcctctttttccataacgatatgttctatctttcaggtcggaacgcgaacgctccgcgcctgatacagggaaaagtgatgtttgttgaaatatccgagttggactaaaaaagctcacgacagaggatcacagagtctcacggagtgaaaatatagagtacaaaactctgtgagactctgtgaaaccctgtagtgaatgaaattcaaaaaaaataagtaaacatgaatttaaaatttttatatctgttattattgctgtctgctgcctgttgtgtatcctgttccaaggacgaagaaccggctgataaaggcaatacctctcccgaagaaccggtttataccacgtttaccgatgccggcgaagtgattattcccggagtgcttccggccaattttactccccggtccgtacgggtcaaaggggatacattatttgttgccaacaataatgccgccgaccgttctgttcttttgttgaacttgacgacaggcgagctgatcggacgcatcgattcgtggatgcggaaagatactaaagagacatttaacgctgagataggagatatggctgtttcggaccgttatatttttgtgggcatgtacaactcccgtatcaacattttcgaccgtcgtacccttcagttcgtcaatgccatcgggcgttcggacggaaagtggggtgacgatatttacagcatgactcattgttacggtcttagcgaatgtggcgagaggctgatggtgcgtgataaaaataccattcgcggttattggatttatgaagctgttaccgagcctgcgtttcgtgtcccctggatcggaaaggtaaaggtacccgaaggaatcggatatgactatcagccccgcattcatggcatggcggagcataacgggcgcatgtacctcaccgactggtacaacaaaagcctgcaagtgtttactccctcaaaaatggaaattgtgtttggcgaagagacacacatcacttccgatgccgtatttaagtacgacgccatacagcctttgggactgctgtcctatggcggagagctcctgatgtcagtacaaaagagcgggaagatacagcgctatgaccccgagacgggcgatttgttggggctgttagccgaatttccggacaaggaaatcgggcgtatggagatagcccggggaatgctttattatattgacctcaaagccggaaaactgatgaaggcaaaaggagaatgatttaccacagagtcacacagagtctcactgagttttattcttcatcatttttactccgtgaaactctgtgaaaccctgtggtgaatctctttccgttatacattcatcgcatttgctccgagtgcacccaagtcttagaagtgaatttatgccgtctgaaccggtatcttcatccttatacctttcttcaattaacattgttaacgctttttttaggctgtcttattcttatgcgcaaataacaagtcttttgcatttaaagaatttgttattcgcatccaaagaacaagctttaactctatgttaaaacaaagcttttgagaacagaaatcttacttttaaaagatgttgattttcagatggttaagtctgaaattcgcttttccgcctcacggatggacttttcgggcgaaaattggggtacttgcttttttgtcaactataaacgagggtttacacttccgaaacttgaataatttatataattccggcaaatatattgtatctttttgaaaagcagatgtgcttacgtgcgcgtaagaggagaaaatcttgtgtgtaagtgataggagggtgggatacctattattgggctacaaacatatacgttatgtagaatttatagaaaaaatagggggaattgtttcaaaaaacgttcgtcatttgaaacacctttttttgacctttttgaaaaatcccgttcttatgaaaaaaaatatagataaaaacactatttttattcataactccttcattatcagtagtgtgttttagtaaaaaagagaaaaaagcaatttatttataaaaatattttgttgttataaaaatgtgccttacctttgtgtttataaacgaacgttttttgaaacaatttcgtccgttttaccactataaatattttcggaaatacttacggtttgaatgagaaaagatgtctcgtccaaaccgcgtagcgcacccgaaagtaacctatcgagttttaatttccaacaataaatgtctgaacaacaggagtattggtttgccgctcggacaaagaaggatcaggagtttgctattcgtaatgctttagaaaagcttggaatagaatactttcttcctacacaatttgtcattcgccaactgaaatatcgtcgtcgtagggtagaagttcctgttatcaagaatcttatttttgtccggactaccaaagagcgtgcctggtccatcacgaaggatgatcacgttcctttattttatatgaaggatctttatacccatactttgctcatcgtccccaacaagcagatggaggactttaagtttgtgatggatttagctccggaaaatgtaacttttgacgaccttcctcttaccgtgggtacaaaagtacaggttgtcaaaggagagttttgtggtatcgaaggtgagttatccagccttgccaatcgcacctatgtggtgatccgcattcatggggttctgtctgccagcgtcaaagtacctaaaagttaccttcgtattctttcagcgtaattcgtaatttcaaaattatatgaatcaagtccaaaatctgcaacacattgcccgtgagttgctttatcttggtacggatggctctcccatctataccgatcatttccgtcaactgaacaccgaagtttttcgcttgtccgaagcccttttctctatgaaaggtgccacttttgaggaagaagcagcgatttgtctatccctgttaatgggttataatgctaccatttacaatgatggcgacaaagaatctaagatacaaagcattttagatcgctcttttgctgtgttagatcatcttcccgcttctctattaaaatgtcaattgctgacatattgctatggcgaggtattcgaggaagatttggcacaagaagcacatcaaataatggatggctggaaaagcagggcgctctcagaagaagaattggaagtgatggaaacattgcagacaatggaagagaatagctatccatgtagcgagatagaagactgattatatgcatttttgatgaataatataaaatatgcttaatgtagataattttattggcgataatatcacttttcgtcgttccagcatgtttgctcccgatattgcagcaaacagtgatcgtcttcgccaggaggttgaaggtaagagtttattggtaattggcggtgccggttctatcggttcttcctatataaaagccattcttccttttaagccttctaaacttgttgtgatcgatttaaacgagaatggactggccgaacttacccgtgatttgcgttccacttatgggctgcatattccggaagagtatcgtacttataccttgaactttgcagatcccatcttcgagcggatgttccgtaaggagcagggttttgatattgtagccaatttttcggcacacaagcatgtacggagtgagaaagacgaatattctgtacaggccttgattgagaataatgtaatcaaagccaagaaactgcttgatctgttatcggaatttcctccccgtcatttcttttgtgtttctacggataaggctgccaatcctgtgaatataatgggtgccagtaaacgtatcatggaagatatgataatggcctactcctctaaatttaaggtcactactgcccgctttgccaatgttgccttttctaacggctctttattggccggttttattgaccgtatcatgaagaaacagcctttggctgcccccaatgacgtgaaacgttatttcgtttcacctgaggaaagcggtcagatctgtatgcttgcctgtattcttgggaataacggagagattttctttccaaagttaggtgaggaaaagatgatcactttttcttctatctgtgaccgtttccttcgtactctgggctatgaaaagaaagagtgtgctacagatgaagaagccagaagatatgctgccgaaatgccggatgacagcaagatatatcctgttgtttattttgaaagtgataccacgggtgagaaaggctacgaagagttctatgtgcccggtgagcggttgaacctggaacgtttttcttctttgggtgtgattgaggatgtcagtaaacgtcctttgtctgaattggattccttctttgatgagctggagtccctctttgcccttccggattgccataagtctgatatcgtgactgcacttaaaagattccttcccaattttgaacacgtggagaaaggaaagaatctggatcagaaaatgtaatgtttacaagtatgtataataatataactactttcatccatagcttgtttggtacggatgaatttgttccgttgcacgctcctttatttatcggcaacgaaaaaaaataccttgcagaatgcattgatactacttttgtctcgagtgtgggcaagtttgtcgatcgctttgaggagcaggttgcttcctataccggctcaaaaagagctgttgtctgtgtgagtggtactaatgcattgcacatgggtatgcttcttgtcggtgttgagcgtgatgatgaagttttaactcaggctcttacttttatcgctacctgtaacgccatcagttatattggcgcacatcctgtatttcttgatgtggatagagatactttgggtctttctcctcttgctgtaaaaaggtggttgtctacgcatgcggaagtaaggaatgggcagtgttataataagaagacgggacgccgtatcaaggcttgtgttcctatgcatacgttcgggcatcctatgaagattgacgaattgtcggcagtgtgcaacgaatatcatatagaacttgtcgaggatgcggccgaaagtatcggcagtttctataaaggccgtcatacgggtactttcggaagagtgggagccatcagttttaatggtaataaaacgatcaccaccggtggtgggggtatgttgcttttccaggacgaagagctgggcaagtttgccaaacatttgacgacccaggccaaagttccgcaccgttgggcatttgttcatgaccatatcggttacaattaccgtatgcctaatatcaatgccgcattgggttgtgcccaaatggagaatcttgacaggtatgttgtcaataaacgtgagacagcggaacggtaccgtgagtttttctctcgtattcctgatgttgagtttgttgttgagcctgcgaacagccgttctaactattggttgaacgctgtacttctgaaagaccgccgggcccaacagtctttccttgaatatacgaatgaccatggtgtaatgacccgccccgtttgggaattgatgaacaggcttgatatgtttcggggatgcgagacggatggtttggagaatactgtgtggttggaagaaagaattgtgaatataccaagtagtgtaagattataaaaaatatggaagagaagattttaattattatcaatgagataaggaaagctaaaaatttgtcagaattgagtgttattaacttaagtgatactttaagagatgatattggatttacttcatttgatttggcagaacttaccgttcgaatagaggatgaatttgatattgatattttcgaggatgggttagtaaatactgttggtgaaataattgagaagttacgttaatatgggactgtttttagtagatcaacataaatcatatacttatgaagatctgttgcaacggataaatgaagcaaagtcatacattccactgatgcagacgaataatttatatgatttctttttgaatatgatcttatctttgatttccgatcagcctctaattcttttagactcagatactaaaatgaatgaattagaaggaatagaaaatacagatataaataagcctaggaatattctttttgatgataaagcagatatagatgatctgataaatagtgttttaacctcaaaatcagaaataactatattcacatctggtaccacagggcagcccaaaaaagtagtacatactattgggacgttgactcgttcgacaagagtttcttttaaatatcattctcaaatatgggcttttgcttttaacccgactcacatggctggtttgcaagtcttttttcaggcttttgcaaataaaaatgctttaataaatgtttttaataaaaaccgagttgaagtatatgaattgctttcggaataccatgtaactcatatttctgctactcccaccttttatcgtttattgttaccagtagagaaatcttatcctgaagtgtgtagagtgactttaggaggggagaaatctaatactaaactttatgaatcaatgcttttgatatttccgaatgctcgaataaataatatatatgcttcaactgaagctggttctttgtttgcagcaaaaggagatttatttcagattccagtcgaattgaaggataagattaaagttgaggatgaagaattattaattcataattctcttttgggtaaatctgatagcttttcatgtgtaggagattattaccattctggtgatttaatagaatggattgactctgataaaggattatttcgttttaaaagtcgtaagaatgaactgataaatgttggtgggtataaaataaatcctggagaggttgagagcgtcatgatgcaatttgatggtgttcaacaggcttttgtttatggcaaaccaaattctgttttaggtaatattctttgcgctgaaataaagattgaggagggatgtagtttgtctgaattggatattcgtcactggttggctgataagttacaagagtttaaaattccacgtaaaataaaatttgtggagaatatagcattaacaagaacaggaaaattaaaacgaacatgaatatattagttacaggttgttctcgtggggtgggccttgagatttgtagagttttgttggaggaaggacatgttgtttatggagtttctcgtagttattcgaatgaattccgaatacttgaagaaaaatatgaaagtaaactcttttttaaaagtgttgatctctcagatacgaccaatattcacaagatcatttttaaagagtttcttactaactcagtcccattagatggttatgtaaataatgcagctgtggcttatgatgatattattaccaacttacaaatagataagttaagggtaatgtataacgtgaatgtattctctccgatgctgttgactaaatatgcaattcgtaatatgttattacatcatattcaaggaagtataatacatatatcttctataagtgttcatacagggtataaagggttatctatgtatgcttctagtaaaggggcattagaagcattttccaaagatactgctagagaatggggacagttaggtattcgttctaatgtggtggtacctggttttatggaaacggcgatgagctcttctttaacagaagaacagaaagatcgtatttacaaaaggacttctttaaaacaggctactgatgtacgttctgtggcagaaactgtcgcttttctattatcaaagaaagcttgctctataacaggacaaaatatatttgttgataacggtactatttagtgatgaaacctactctttttattgttggtggtagtagtactgccttggaaatccgagaaactgtagatcagttttttaaggataaatattttgctgtttataacgttatatcagatgaagaacctcctattttacaaacttatattagagactcgtctttattagatagattatctacaattgaggtttctcattatattataggatttaccaacagaactttacgcttacggtttgttgatctttttggtggatttaacagtgtacttgataatgtcattcatccatcttcttatgtttctccttcagctatattaggtaagggtaattatttggccgctaatgctgttatttcttccaatgctcttattggaaattcaaatctgattaattacaatgtgactattgggcatgatgtcgttgttggttctgattgtttctttaatccgggagccagaattagtggtaatgtaaaaattgggaatggatgtttatttggtgcaaattcttttgtatttcaaggacttgaaataaaagatgattgtcagattgatgcattatgttacattgatagagtaatagaagcaaatagtatgtgtacaagtaatggagggagcttaagagtatataggaaacggtattaatagatactaaagaaatggattaccaacagttgattgtggatataaatgtttccatattgcatacattggagcaaatggataaatgtaacaggaagcttttattagtgttttcagaaggagaatatttcggtttggttagtattggagatattcaacgcgctataattggtaataaatccttggatacgcctattaagaatattttacgagatagaattattactgctgacgacactttaagccttgatgaaatcagaactttaatgatgtcttatagaatggagtttattccaattctgaataccgagaggaggcttgttaaagttttaatgtggagtgagcttttccccaatgaagataatgctccaatagatcagtttgatcttccaatagttattatggcaggtgggcagggaacacgtttaaaaccgttaacaaatattattcctaagccattaatccctattggagagaaaacttttatggaggatattatggatcgttttgttaaatgtggaagtaataacttttatgtttctgtaaattataaagcagatgttatcaaacattatttttctactctcaaagattcgtcatatcgaataaactattttcaagagaatgtgcccttgggaactgctggtagcttaacattaatgagagataaaatacacactaccttttttgtgtccaattgtgatattataattaatgaagattacagtcagatactgaagtatcacaaagaaaataaaaatgaattgactgttgttgcggctcttaaaaattatccaatagcttatggcgttctttatactaaggaaaatggtctgttagattcaatcgtagaaaagcctgacttgacttttaagataaatacgggactgtatattcttgaacccaacttattggatgagattccagaaggacaattttatcatataacttctctaatagataaactaagaaaagaaaatagaagaataggggtttttcctgttagtgaaaaatcttggattgatgtaggtaattggaatgagtatttctcaattattaataaatagtcaattattataggcatgaaggttctaataattggaaatcgaagtcatcagtttatatacaattatgtgaagactctaaaaaaagtttatcttaattcagatttagaaattgatattctttctcaagatagttcagatctcttttttccttctgataaattttataataatatttatgctttaatagtaccgtctttttttcaaaaaaatcgtttcttaaaagttctttatcaacatatattgtttcgtaaatatattaaaagacttgatttttatgatgtagttcatattcattatgttgagaatataatagtacgagatattaggttcttttcgaaatatatccgtggaaagttaattgtttcaatatggggaagtgattttttacgtgcatcggaagataggaaaaaaaatatgactgtgctatttaatagagcagatcatataactattgcatcggataaagttatagaagaatttaaagcttgttatcaaaagagttcttttctttccaagatcgttttatgtcgttttgggttggaacctttagaaagtttgatttcgattttaaggagtggtgcaaatgcaagaattagtaaatctaaaataggattatgtgcagacaaaatagtaataactattggatataatgctagtaggttacaacatcatattgatattatagagaatatagaacgatctcctttgctgtctccctttcatgataaggtagaatttcttttacctgtaacctatcccaaagatgccgaatatattggtataataaaaaaaacagttcttaattcgaagtttcattataatgtaattgaacaatttttgtctgatgaagatattgcacatttaagagttgcatctgatatttttattcagctacaacctacagatatgctttctggatcgatgttagaacatttaagtgcgcagaatatagttataacaggttcgtggttaccttatgattgtttagatcagtggggcgttttttataggaaaatagattgtttggaattaatatcaaatgaattacatgatgttttgaacaaatttgttccttataaaaagctcacttgtaagaattcagatataataatagacaagtttagatggaataatgtaattcacgattggctggatttgtacatgaaaagatatgataataaagaaagtttttaagaaggtctatcatttaatttatcctcctagagtgagatttaagcatggccaacgtttttacagtaactctttaattgatacattatttccagaactagtggaaataggtgatgattttatttctgcaccaggatctattatattggcacatgatgctagtactctttggcatacaggtaagtatcgagtacaaaggactaaaatagggaatcgtgtttttttaggagctaatagtattattttaccaggagttgtagtaggtgatgatgtgataataggctcaggaagtgttgtcactaaagacatagcttctaattctgttgtagcaggaaatcctgcaagagttgtttccactattagtgaatatattgataaatgcgagcagcgtaaaattctttatgctcctaatgagaaatttattgatttaattactagaggtgaaataattactgaggaacgacaaaatgaattgagggacactatttatactcagctgaaatgaaaagaatgtgtttgtcacttataggtgatatctgttttcccgaagaatttaaacagatttttactttagatggaaagtttctaattacaagaagtttaggatccgattggtgttttgagatgagtggggaaagtatgttttatgcattatgtgagatagagaaatctcaaaaagaatctctttctgattataaattaagaataatagaagccattgatagacgtataacttggggtaatggaaaactattgcatcgtagctttacaggagattatgatatacaatttcgttcgacaaattctgcattgagaacgctgttgtatgcttgtgaagatggatttgatacagataaaaatatcagaatcatagcaaatgaacaatttaaatatttttttgaatggaaagaaggtatttggttttgccatgattcaagtgagtatggtggaaaaacccccttttcacatattagatcaaaagtggcaggtaagagttggaggaatactttaaccttgaatactcatattgattctttgaatacacttctattactaaaattctataggaaagaacatcttcttaactttgatttagactattggataaacaaaggtcttatttccataaatcaacttttggaattaactaataaaggaaaaatgatgaataaattgcaggcaatggataattattgcttgaatttatttttgaaagaacaacataattcttttttgattgattgcgtatatgaaaaaattgttcatcctataatttttaaacttgtatttcctactgtcttttttaataatggttttatttccagggatttatctgttttaaataggcatatagattatcagttagtcaacattgttgattttgctcgattgctgaatctctacaaaaaaaatagggaaacagagatactaactacaagtattttaaactataatgaaataggggataaattagaacgagctattgactttgttgaaaataataaatctctgttgagttacatccaatctagtgatttacaaagagcttggtatgcagagatgtattatgcaatgtcaaatataaattctaagtatataaaaatggcacagaatctttattctgatcagttatattgttccgagagccccttttataaattggattttttgaatgaaaagaattaattcagattttatttcaggttttatcaagagaggaggtttttctgtctttttctctacagctttggtaaagataagtgccgcactactttctattattgttgtgcaattacttactaaagaagactacggaatattatcttacgtattgtctatatatgccatagcaatcgttattgcaggatttggagggaattattcgttgttaagatttggttcaattgtgaattcattcttgaaaaaaaaacagtattattattatactcaaagggttgggataaactatacttcaattgttgttgctattatagttgtttattctttttttctacctgagggtatgaagaatgagtggcttttaattgtttatatgtgtctaggattgtatagcttttatattttagaaacaatgcgtagttatttccgaattgtaaatttaaatagaacctattctaaaataaacgtgtacaattctgttatattattattactgacggtttgcttgactttgttttttaagaactatggctatattactgctcttatattagcaccgttattgactttctttttgtttaggaaaaaaatctcttatatacaatttagtaacccgattgagatttctaaaaaagaatattggggatatggaatacatacaagtgttagtgcaattgctaaccagattattttctctattgctcctttgcttttaggtatattgaatgaaccggaacacagtatagcaagttttagggttgccactataataccttttaatcttttaactctacctggaattttgatgatctctgattttagctatttatctaggaactatatggatagtaattgtttaaagcgatattattataactatctgaaagtggtaattcctatttcatttatagtctttttattattgattatatatggggattttgtggtagagaatctatttggggcacaatataatgattgtgtatatatgtataagatgtttatggttgcaacatttgttacatatatttttcggaatccattaggaaatatattactcgctgttggaaaagcaaagtggaatggatataatacttatgctttttgctttttatatattattttctcacttatattttatcaatattggggtgttatagcaattgtttatggtttgtgcgctacatttattttgtcaggtatagtttctctttttttgttttattactatataaaaggtttgcggtaaaggtcgatgtttccttattttcttatatattttttcttactggtcttttgctctttaggaagtgttactaaaaatcgcttttttctaatttgtgtatttattcttttttccattttctctgggtttaggtattatgtaggagtcgattatattaattatgtgaaaatatataatcttgaagaggggtatggaagtcgagaattaggatttaacttgattctagattttttgcgatatatcggggctagctatcaattcatgttttttataatggctgttgtcatgcaaatactggtatataatgttattaaacgatataattacagtgtttggatttcagtttttatttattattgtatttctccgttttatattgcaacctttaatgggatgaggcaatacttagcaatcgctgtttttattgttgcattaaagtatattgaacaaaaaaaaatatttaagtatatcgtttctcttttgttgggaggattcttctttcatgaatcgattttagtttttattcctttatattatatattaaataagactatatctataaaaggcaaattacttgtgtttttgttgactattgcgggtagcttggctatagataaacttatttcctatactccatatattgtgtatttgacaagagatcgagaaactcatataagctcattcacttatatttttgcgggcatttcaattttatttatcatcttttggaataagcttaattcttttaaaagtaagcttataatggagaatatgaatcttttttgttttttgtcattattagtagtgttacttcaatctaatggagtgcttattcaaatgactctccgaatgaatagttatttcttctttgtgtatatcatattggttccagccgttatatcatctataaagaatgtccatatgcgtattggtatgtatttcagccttcatttagtgctgttattataccttgtccgtaccatttgttttaatggacatttgtatgatttggttccttattctatgaatttcaacttatttaaataaatatcatattatgaagattgctgttattggccttggatatgtaggtctgcctttggctcgcttattttcaacaaaatatcaaacaataggttttgatatgaatcagaaacgagtagaatctttaatgggggggcatgatactactttagaagttgctgatgttttgttacaatcagctttagatagtggttttaaatgcacttctaacttggaagatatacgtgattgtaatttttatgtaatagctgtaccaacaccggtcgatagaaataatcgccctgatttaacaccgttgatatcagctagtgaaactgtgggaaaagtaatttcaaagggcgacatagttgtttatgaatcgactgtgtatccgggggttactgaagaagaatgtttacctgttgtagaacgtgtatctggattaaaatttaatctcgatttttttgctggctattcaccagaaagaataaatccaggtgacaaagaacatactgttgaaaaaataaagaaggtgacatccggatctactccagaaattgctgacatagtagataaagtatataattctgttttgataaatggaacacacaaagctccttctatcagagttgctgaagcatctaaaatcatagagaactctcaacgtgatgttaatattgcatttatgaatgaattagcgaaaatatttaatgcaatggatattgataccaatgatgtgattgaggctgcttcgtcaaaatggaattttataaaattgagaccaggattagttggtggacattgtattagcgttgatccatattatttgatacaaaaagcgcaagtgtatggggttttaccaagaataatgtcttcagcccggcgattaaatgatggtatgggcgattatgttgctaatcaagtaatcaagttgatgaataaaaagggagtattggtgaaagattctaatatattactacttggtattactttcaaagagaattgccctgatatacgcaacacaaaagttgttgatatatattcaactttgttagagtatactaagaatatttccgtttatgatccttgggcaaatgcagaaaaagtgtatgaagagtatggtattcgtatgattgataatgttaatgaaaaaaaatacgatgctataatattggcggttggacataatgagtttaaaacaattgatataaaagcacttggcaatgatatttctgttgtttttgatgtcaaatgcttcttagacagagcaattgttgatggacggctgtaagattaatatgatttctggattagttagtgtcattattccaacttataaacgtcccaatatgttgggacgagctatagacagtgtactcggtcaaagctatactaatatagaggtggtggttgtagatgacaattctgatggtgataaatatcgattggaaacaatccaatatatggaaaggtatgctaacgattatagagttaaatatataaaacataaaacaaatcagaatggctctgccgctcgtaatacaggtattcaaaactctgtaggagagtatattgcttttcttgatgatgatgattatttcttaaaagatcgaataaaggaagccatacattttctacaaaattcaagtgcagattgtggtggtacttgttgtaattacgtaaagaaatataaaaataagatatataaagtaagtcgaaacgtgggctgctttaattcatgttatgagttgttgtcagcacaaattgattatgctgctggttctactttaataattaaaagggagatattaaataaggtggggttgtttgatatttcttttaagcggcatcaggattgggagtttttgattcgtctatttagattctatcaaatagaaattcttccttatgtagatgtagtgatttgtgctgatggaataagaaatacacctcgtactgatgttttgttggaggtgaagaggaagttgttacaaacgtttgccactgatatcgaaatattggggactcaagagcaggctgatatttatcaggcacaatggaaagaaattatatataattatttaaaagagaaaaaatatagtacagctatcgcttttgctcaaaagaatatttcaaagacttcctttaggaagagggatatacttaatgctatattgtcttgtatcgttggtatcattccatcttttatgattgtagtgtattcaatttatgatcttaagtttaacagatttaaaaaagatattatataattatattcatgttatatgttatcatgtctttgtatgcgaaagacactttattgaaagttcaagaagcgatagaaagtttgcttaatcagacatatacttctttttatttatatattatttgtgatggtcctatagaaaatggtgtagcttcctatgtaactaatttgttaacagaacaaatctgtataaatacgagagaaaagaatctggggttggcttattcattaaatgagttgttagatgttgtcttgaaaaaggaggattgtacctatattgctcgtatggatgctgatgatatttccatgccggaacgttttgcaaagcagatcgcatttatggactcacatccagatgttgattgtcttggtacttgggcaatagaaattgataatgagggaaaagaatacttccgaaaaaaaatgccgacaacccatgaggaatgtttggaactatttaaaaagcgggattgtatgattcatcctactgtgatgtttcggcgttcatattttgagaaagctggtttatatccggaagacacttactttggagaagatactatgatgtgggctaagggttttaaaagtggatgtaaatttgccaatgtacccgaatacttattcaaatttagattagatttaaactttttcgaaagaaggcgggggtggaaacatgccaaatctatttataccttacgtcgtcgcgtcaatagaatgttggggtttggatggaaagaagactgttatgctttgctgtatgctatggctaaattaatgcctaaatcagttcttgatataatctacaaaacagttcgttaattttacttttcttataaaatatataactcatgaaaataccattttcaccaccttatattgacgaggcggtcatcaacgaagtcgttgattcgttacgttccggttggatcacatccggtccgaaagtgaaggctttggaggaagaaataaaatctttctcgggagcaaaggaagtactttgtgtcaattcctggacatcaggagctattatgatgttgcgttggctgggagtgaaggagggagatgaagtaattgttcctgcttatacttatagcgcaacggcattggccgtgcttcatgccggggctaaaccggtgatggtggattccggaatggattttaatatctcggtagaggctgttcgtaaagctattactgctaaaacaaaggcaattatcccggtagacattgccggttttccttgcgattatgaaaagatcatggcactggtacaggaatctgaaatgataaaattgttccgtgcggaatctcccgtgcaagaaaaattagggcgtatcttggtgatgaatgatgctgcccattctttgggggcacgttacagtaaccggcagcgtaccggttgcgaaactgatgtggctatcttttcactccatgccgtgaagaacgtgactactgccgaaggtggagccatttgtttgaacttgcccaagccgttcgataatgcagagctgtataaagaactccggatgatgagcctgaactgccagactaaggatgctttttcgaaatctaaagccggaggatggcgttatgatattgtcggtttcggaatgaaaatcaatatggccgatgtgaatgctgccatcggactggcgcaaatacgggaatatccggagttgctgaaggagcgaaaaagggtgttcaatacttacaatgatgctttttcgacttgtgactgggccatcgttccgccttctgtagatggagaaaaggaaagctcttatcatatttatgctttgcgtgtgaaagactttacagaagagcaacgtgaccggatgattgacgagatcgctaaacgtgaagtggctgtgaatgtacattttataccgatgccgatgttgtcgttcttcaaatcgatgggatatgatatggatgattatccacaggcttatcagaattttaagggtgagatatcattgccgatatatcctcaactggatagtgaaaaattgaatttcattattgatactgtaaaggcggcctatacgaccgtaatcgcagaaaacagatagtatatttacaaacactaaacagataagcttcttgattcgtttttttgatattgttttttcccttttgggaattcttctgctttctcccgtttttctctttctttatatagccatctgccttgaaagtaaaggaggcggtttctataaacaacttcgtgtgggacaatacgggcgggacttttatgtctataaattccgttcaatgcgtgtgggggctgataagaagggactgataacggtaggggggagagatcccagaataacccgtaccgggtattttatccggaagtataaattagatgaattaccccagttgttcaatgtactgaaaggtgatatgagtctggtgggaccacgacctgaggttcgtaagtatgtggatttgtatactgatgaccagaaaaaggtattgagcgtacgtcccggaattacggattatgcttctattgaatatgtggatgaaaatacgattcttggaaaggcttcggatcccgacaaggcatatatagaacagattatgcccgataaaatacggtataatatgaaatatatatgtaatcgttcggtgaaggaatattttaaaattatatttctgacattttggagcatcattcgttagatacgtttttaaagaaagtggggaaaatccttctttttgtttttgtaccttattacgtgagaaagaagaaggaggagtagctcggaagtaagttccggaaagaaattaattcaataaaagagaaaggatcagcaattgctgatcctttctcttttattgagcctcttgtcggattcgaaccaacgaccccgagattacaaatcacgtgctctggccaactgagctaaagaggcgtcatttctgttttgcgggtgcaaaggtaggaaaaacttttaaacttgcaaatactttggcaaaaaatgcttcataaaaatagtgtttgataaatcggattctttgtttacttttgcaaatcaattaattatagaaaagtatgaagaagaactttttttatgtatgtggtctgtcattgcttctttggggtatggcagcatgttccggacagggaaaagcggataaagcaaccgttgttgcggatagtgtagtggtgaaaacggatagtgttgcggcagacagcacaggatatattgtgagagtaggagagatggcccccgattttactattactctgacagacggaaagcagatagagctttctgcacttcgtggcaaagtggtgatgttgcaattcacggccagttggtgcggagtatgtcgtaaagagatgccttttatagagaaagatatctggctgaaacatcaaagcaatccggagtttgccttgatcggtattgatcgtgatgaacctcttgacaaagtgattgcatttggtaagtcggtaggggtgacttatccgttgggattggatccgggagcggatatatttgcaaaatatgcattgcgtgaatcgggtatcacccgcaatgtactgatagaccgggaaggtaagattgtgaagctgactcgtttgtataacgaagaggaatttacttcactggtaaatcaaattgatgaaatgctgaagaaataagttgaacaagcaggggtgattttttgtttttaacatggaatcaccccatctttttattttatggctataacgattattattctcgtactgtcggctgcctttttcatgagtggaaaggtacgttctgacttagtggcattgtgtgcgctggtattattaatacttttcaatatccttactccggaggaagcgctttcgggcttttccaattctgttgttattatgatgatcggtctgtttgtggtgggcggagctattttccaaacggggctggcaaagatgatcagtagccgtatcctgaagtttgcgggaacaagcgagttgaaactctttgtactgatcatattggtgacagctgctatcggtgcttttgtcagcaatacgggaacggtggcgttgatgctgcctattgtggtcagcatggccatgagtgccaatatcaatgtaagccgtctgctgatgcctcttgcttttgccagcagtatgggtggtatgatgacgttgattggtactccgcctaaccttgtgatacagaatgccttgattgaagccggatatgaacggctctcattctttaccttcactcccgtgggactggtatgtgttactgtcggtctgattgtgctgatcccgctgagcaagatattcctgacgaagaaaacagataaagaaacgcggggaaagcataagaataagtcgcttcaggaattggcgggggaatatcagttatcgcagaacctgtatagggtggaggtcgaagaatcttcaggaattgtcggtaaaacaatacaggagttagggattccgcagaggtatcatgtgacaattctggaagtgcgtcgccgatcggtttcatcccgacacttttttaagacaaaaaagcaggagatggcagaagcgggaaccctgattgaagcagaagatattctttatgtattaggggagtttgagaacgtgaaacgttttgtcggtgagaatcgtctggctttattggatacacataagacggaaggtaatttgcataatacggatgaaggtttcgattttcaggagataggcattgccgaaatcttgttgctgcctactgccaatttgataaacaaaccggtaaaagcttccggattcagggagaattacagcattaatatattgggaattcagcgcaagcgtgactacttgttgaagaacctgaaggatgaaaaaatgcattcgggagatgtcttgctggtacagggaagttgggcaaacattgccaggcttggtgaagaccagtcgcaatgggtcgttctggggcaaccattggctgaagcagctaaagtgaccttgaaccataaagcaccggtagcggcactgatcatgttggggatgattgtaaccatgatgttcgactttattccggtggcccctgtgacggcagtaattgtcgcagctctgctgatggtgctgaccggatgtttccgcaatgtggaagaagcttataaaacaatcaactgggagagtattgtattgatagcgggaatgttgcccatgtcattggcattggagagaaccggggcttcggaagtggtgtcgcaatcattggtgaacggtctgggtacttacgggccttttgctttgttggcaggcatctatttcactacttcgctgatgacgatgtttatcagcaatacggctactgcggtgctgcttgctcctattgcgcttcactctgccgtacagttgggactgagtccctatccgtttctgtttgccgtgacggtggcggcgagtatgtgctttgcctcacctttctccacgccgcctaatgcactggtgatgccggcaggacgctatacatttatggattatgtaaaagttggtcttccgttgcagatcattatgggcgtggtgatggtgttcgtgttgccgttattgtttccgttttagtcttttaggaggactggttatcgggaattttcatgcctgcccggtcacgggacaacagtcagtttggccaggtagtcataatgtttgccctcttttatcatttcggccttgaagccattgtcggcagcataggcactgagggtctggaagtcgatatacagccagtcgaaagaatcaccttgaatgtctttgtactgcatgcggaagtcgatttctccataataatctccggccaggtcgattaggaaacttccgtcttcatcttcgaacagatagcggaggtcacttgaatccatcaggatgcaaccattcgggcggagtatttgtttcatcttacggaagaagacaggcatattctccaagcgtccgatgataccggaaccgttcatcaacatcagtatggtatcgaaagtatcgacaaagtgttcgtcgaacagattaatctggcgggcatcttttactccccgttgtttcattacttcgacggccagaggagagatgtcgatggcagaaacgtctttgccggctttctgaagcgcaagggcgtggcagccacttccggcgcctacgtcgagtattcttccggtagccatctgaagagctgtgcgttcgagcaggggcatctgtccggcttcgcggaaaagttgtttgacgggtatttcgtcttcatcgaactgagaagaaaatacacgcagtctgtctgccttgtgattgtgataataatcggctatggcggcacccatcgggtctttttctgccgggagcaggaatgtatccattgattggtttttagttgttacagcgggcaaagatagggaattcacagaaaaagagtatctttgtccacggaaaatatagaataagaaaggaaagattatgagtttagaagatgcaattatgggtgggattgtctttaaaggaaagaaagaaggcccgaaaaaagatgaaaataaagtgaaaacaaaagcgaagaaaacaacttatataaagggaacccatggttccggagcagccaagatgaaagctgaaatccggcgaaagagggcgaatagacataaacggtaaataacgatgaacgataaactgtttgcaatattaatgtgcagcctgtttatcgttcattgtttagaaacatgcgtcgtttatcgttttagaaccgctccggcaatatttcgatccagtaatcatccggatcgttgataaaatacagtcccatggcagtattctcaaagcatacgcagttcatttctttgtgatattggcgtatggcatcataatctcccgttacacggaagcagagatggctttcgttctctcccaattcatatgcttcggtatggtctctcagccaagtgagttccaataagaatccggtggtgctatctgtgagatataccaggataaacgaaccgtcggcggcttctttccggtgatgttctttcagtcccagtgctttttcgtagaaagcaatgctgcgttccagatcagtcacattgatgttaaagtggtcaaatctactttttatttccattgttgctaagtttattttgttttaggttaaaatagaacttataaagttgcaccacagattatactgattagagcagattgtttatattaataatctaattaaaattcaatctgtgtttatccatgtaatctgtggtggctgatttatttcataaatgcttttgttattttacctgcataagttctgggctgtccttccattggtgtcggggcaggcagcttctgacattccagtatgacagacggctcgctttgtcctgtaggatagaaacgtatgctatatgtctctgctttctccaattgctcgtaaggctggtcgggcgagaggatactgaatacaacagggcttccggaaatttttcctatggatcctccggcgttagctgtcatcatggtcatgttgaaaggatcggagccgatagcgatcaccagtcggcctgcacccatctggatggcgttggcaggaacttgatcgggagctacctctttatagcccggcattgtgcttggaggggtaacagggattgcgggggtaaccgtagctgctttttctaccttttcagtttctttttcaccaccgattaccacaactttcggagcggtcactactgccggctttttcggagcggcttctgctgctgcggcttcctgaggtttttggctcagtgcttttgctgcctcttcaaaaaggttatcggcaaagtctaccgtcttcctgcgccatttggcaagaccacgtaccagtttggttttggttttattcagagcaaatttatcggtgatccattcttcggctgtatatttttctttttcacgataagtgtagcggattttttctatttccattgtgcacttctgcggctggcagttgacggtgatttgataggtcagccaagtacggtccaaagaaagagcggtagagctgaataccagccattcttcgccggttgcggcaatgacaccttggtctttatataccacgcggctattgtttttgttctgggccatgcgtccgtcaagccacttgagcatccgttcatagatttcgtcttgtgacatgccgggaatgctgaattcgcggctgaaaactacccgtccgtcaacttcgggcacggcgcccgcaaggtatctgctgtcatcatcatctttgtcattgtctgcccaaagggttgcaggcaggcaaatcataaataacacgagaaaaaattgtgtcagtttgttcataatcgtatgttttatttagttatatctcaaagctttcgccccggtgagtgatggtgatgaaacggcatccaccggcttcggctatagaccggaaagcattacctccctcgtagtcttcgctgaagtgtatgggtacaaatatagtagtttttattcgttcgatgaattgttgggcacctttcatataatcttttcccattcggcggtcgacggggaacattaccagatcgacggccggagcagattcccggagaaatttcacttctgccagaaagtcgccttcggctttgcgtatctcttgttcggtagactcttcgctccaatgccaattgttgaggtcaccggcatggaagatgcttttcccttgcagatgaatcaggaaggagatgcctacgtccgtagaaccgaaagcctgaatgcgcagtgtatcatcttcgtactcctcacctttattaatatagatcgcatcttcactttgtgcccgatgatgcttcaggatatcttttgagaagatatagatgatgtctggacgttgctctttccaggttagtatttcccggttaaaatggtcgggatgaaaatgtgaggcaagtacatacagcttgccggggcgttggagcagacggtcgtgtacgatacctttatttcgttccgtttccgaagagtccttgtaataatcaatgataagggttacaccttctgcttcgatggcaaacccgctgtggtatatataatccagaatcataagcggatgtattttatgaatgcaatattacgtattatttgttggttgcgcaagcacaataaccggaaatatcaaggggcaagcctctctttctgccagcttccgtccgcttggagggtgtagagaaagcggtcgtgcagtcggttggctctaccctgccagaactcgattcgttcaggggtgacggcatagcctccccagtgtaccggacgttccacttctctgcctacccatcgggcagcttctgcaacgaaactgcgaatcaattgcatccggctcttcaacggacggctttgaggagagatgcgtgctccgatgcgacttttgtaggggcgttggtggaagtaggcgtcggattcaccggcagggacttttgaggaaatgccttcaatgtgtacctgtctttccagcgcgtgccagacgaaagagagggaaatatacggattctttgccagatgactgcctttacggctttcataattggtataaaagataaattttccgtcatgcaaatctttcagcaatacggtacgggtcgatggtcgcccttcgggggatacggtacctaccagcatggctgtaggttcttctacctgtgcgtcgatagcttcgtgcagccatcggttgaaaagagaaagcgggttgtcgggaagatctccttccttcagcccgcctttggtgtactcctgccggatggcagcgaggttgatagtctcactcccggcccctcttccgtgaagaggggaatcaggatgtgtggacgtatgatcggttgacataagcaattactttaaatttacatcggtacttctatcagtaatatcttggagtctttcagggtttctatctcaaagcttttggtttcagagattcccaatccgtcgcggcgggtcaggatgatatcgtctatttttatttctccttcgatgaggaaaacgtagactcccgtatccgttccatgtatcttgtattcaagcgttttaccggcttctgcttcacccatcgagaaccaggtgtcttgtagcagtttggctggtgtactgccatccggtgacaggatcagggccagttcgttttttttcagcaatcctcggatgtcgtagtcctgatagagtgggtgggtgtttcgctctttgggcatgatccatatttgcagaaattccacaggttccgacttgctgccgttcatttcactatgatagatgcctgttccggcactcatcacctgaatatcgccaacagtgatggtacggctgttcttcttactgtctccgtgtgccagaaaccccttgagggggatggaaacgatttccatgttcttatgtgggtgggtctgaaaaccttctcccggtgcaacacgatcgtcattcagcacccgtaaagcaccgaagtggatgcgttcgggattataatattcatcaaagctgaaactgtggtggctgtcgagccaatcatataaagatcgtccgcgggtatccgagcggtgaactacttttttcataatgtatcctttcttttaaaatgtattctataagccaaacaattgggaagtataaatggtttgaagcgttcacttttttattaggaacaaggggaaggaggcggttccagaagtgaaacaatcaggcttttgaaatccggcaaacagaagagatttgaatgcgttcggtaaatatgagccggagaaaattttgttgaaaatattattatcttatttttgtgctttcaaaatctgccaatagtaagaagatatgagaaagttattgtatgttattctgttagtactgcttcattgttttatatctccggtgtctgtttgcgccggaacgttttctttaccggacagtttgattacagatgacaacgtatataagtatacattctccgactttgaaaaagcgcagcagatcatggagcagttgaggaaacagaagtcgcttcctccgttccggctggatgtggtggaaggcgatttgtatttcaatgtagggcaatactactgggcgttgaaattctataagcgtgctttggaaagtgactcggtgctcaatagtgataaaaactatatggaacaggtgcaccgtatgatttcgtgttacgactgtttgcacaatgagaataaaaaggcacagtatgtggacttgcttttgaagagagctgagttgtgtgatgataaagcgatgcagtccgttgctctgtttaatatggggaagatgctctattatcagggtaataaggataagggatatgaattcatggagcaggcggtagcgatgatggaaaaaacagactacccatataagtacgataacctgcgctataattacaatactttgctgatatttcaggagtcggacaggcgtagtgaagaggccctgaaaacactggctgcattagaaaggatcgtgacggaagagaccggcagtgagataccgatggagggattgagcggaaaggagaaaaaggcgatgtatgcccattacgctgtggttcttttccggttggggcggtcggaagaggctgaccgctattaccggctatttttgtcagtaagtaaggaatatgatcgcgatgactacctgattatgccttatctgttcgatcggaagatgtatgatcaggtgatccgtatgaattctgctcgtgaaaaggtatatgttacgcggaaagatacggtaaattattatatggtcaccattaagaagtccctcgggcgtgcctatcgggataaaggtgattaccggactgctgcaagatattttgaacagctggctgtgttgcgtgatagcattaaggccagagagcagaaaagtgctgcattggaactggcagcggtttatgaaacgaatgaaaaggatatgtttattcagcagcaagccgctgatatgcggatgaggaatgccttgctgatatttgtggtctgtattgtttttctgttaggggtacttttatggagaaccatccgacataaccgtaccatacgccgtaagaataaggcaatggtaggaaccatcgaggatttgctggttcacaaagaagaactctaccggagaaaagaggagaaccatatattgaaagaacagttacagaaagagcgggaagtacggacgtatatagatggaaatgcattgcaggcagaagagcccggaaagtcggatgttcctgtcgatccggagcccgagacggaagataacaatgcggtacacgataaaatgctgttcgacaaactggagcgtgaaatcattaaccggcagttatatcttcagccggacttttcgagagaggagttaatcaagacaatctacattcccaagaataagtttgcgccgctttttaagcaatatgccggaatgagtttttcaaaatacattaataatcttcgcttggagtatgctgccaagatgctgaaagattaccccgattatacagtagacacgatagcccaggagtgtggaatgtctacccaatctttttatcgtctcttttccggtaaatttggggtgactcctaccgattttcaggtaggagtacaacgtgttagtaataaggaaattactgactgaaagtgaaaaaatgagagactaagagtgaaaaaatgagagaataacccacttcaagtattttgatctgtaaatctttccctttacctttgaaccacatcaacgaatctggtttaggtgatgtactgtacccaaaatctgccgggagttttctcccggcagattattctcagcaaggccggtcactgcatcaggctattagaaaatttcacagagttaatcttttaaaaaacacgtattgttatgattaggaaagcattcaaagtaggtgatacaatcaccatcaaacgtacctcacatgcaggtactggttatcgttacgctttagtacgcctgactggtggagttgcccttgtggaggaattgtcagaagatgccgataccttgggtggaatgtctgtacagtcttttactttccagtttttgcagccgggacaggtagagattcagtttgcctattatcgtgatgtcacgggagttctttacgaagacgtattcccttatacagtggttacttccgagaaagcggatataataataggaggctggggagaatttgaaccgttgacggatcaggataaagaattgtttcagacctgcatgactttgaaaggggtggattacactccacttctggttgccaaacaactggtaagcggctataactaccgcttcatctgtatgactaaaacagtaacccgcgagcccaagtatggttttgctaaagtaactatttatgctccgctgaagggagagcctttgttagagagcattgtggaatactgatgaaaaaagggtgaaccgaaggcacataaatagagaatgctaaatagtaatcccggacattatgtatttcatccgggtccccccccttggattaagcctgccgtttcttgagaaagaagtggcaggcattattgtttgttacacatcactttttcgtgttgctcttttctaagcattgcccagtttcacttcattcactaaaggtttccggttcttgaagtcccgtatgttctccaaagtcgttgctgcaatattagccagagcctcgcgggtaaagaatgcttgatgagaagttacgatcacgttattaaatgacagcaaacgtgccagcacatcgtcgtcgatgatacggtccgatttatcttcgtagaagtattcgctttcttcttcataaacatccagtccggccgaaccgatctttttattttttaatccttcgatcagcgcattggtatgaatcagctgtccccgtccggtattgatgatcattactccgtctttcattttgctgatcgagtagtcattgatcagatactttgtctgttcagtgagcgggcagtgcaatgatatgatatccgagctgtggtataattcatcgagcgtcgtatatactatctggttctcccgtgcaaagttataatccggatataggtcataggccaatatgttcatgccgaatcctttgaggatgtgtatcagtatttttgcaatctttcccgtaccgatgatacctgctgtttttccgtgcatgtcgaaacctaacagtccgtgcagagagaagttcccatcccgtgtacgccacgaagctctcggaatcttccggttgagtgaaagcatcagggcaaccgtatattcggctacggcatacggtgaataggcggggacgcggacaacggttactccgttttcggcagcggcttttaagtctacattattatatccggcacagcgaagagcgagtaatttcaccccgttggcggccattgtttttattacttcagcatcagctgtgtcgttcacgaaaatgcagacagcatccactccttgggtcagcagcacgttgtgccggttcaagtgacctttgaaaaatcggagttcgaatccgaattctttgtttttttcgttgaaagaagcttcatcgtagggtttggtaccaaaaaatgcgattgtatatgccatagttttcttattttatattctataatataaaaacgtttagcaatggagtaatgtttggctttctgagtgtcttttcttatgatgttttcttgttcgtttcaatcgaaacagtttgtgttttcaattaatttgttggtgaaaacgtaattagatgcacagaaatattcgtcatgtgcaatattattgtacctttgcgcccgaaataacttaaaaaagatttagatgagaaaattattcttgattagcatcgggttgctaatcgtttcaacttcaacttttgcgggaggtctcctgacaaataccaatcagcacgtattgtttttgagaatgttggctcgtgatgcttctacacaaattgacgcggtatattccaatccggcaggtgttgctttcatggaagatggctttcatctgtctctcaacgggcagagtgctttccagacaagaaccatcacttctactttcgctccgtttgcaggctttggcggaaacactacaaaagtatataaaggtgaagcttcggctccgttcatccccagtgtatttgcagtatataagaaggataagtgggcattctccgggaattttgcagtaaccggtggtggtggtaaggctacctttaatgagggattgggttcattcgagtcattggtatctgtagtgcccggaatgatggtagctgccggtaaagaaatggtagacggaggcattctgccgattaatatctttgaaggtaccaataaatactcggttgacagctatatgcgtggtaagcagatgatttttggtcttcaactgggagcatcttataaaatcaccgattacttgtctgcatttgccggtgtacgtatgaattacgtaagcaatggatatgaaggacatattcgtaatattgaagctaatatcggtggaggagaaatggtaaatgtgaacaaatatttcagcgattatgccaagcaagccagaacagctgcagatgcttatctggcagcgaatgatatggttaattatgcaaaatatgatgctatcgcaaagaaagcgaccggtgttgcagaattgacggctgataaagagttggactgcgaccagacaggttggggggtaactcctattttgggcttggactttaagatgaataagtggaacattggtgtaaaatatgagttcaacaccaaactgaatgtagagaacaagactcgtatagataatacagggctgtttgcgaatggagtaaatactccgcacgatattccggctttgttgacagtaggtgtttcttatgaaattcttccggtacttcgtgcttcagttggttatcatcatttctttgataccagtgcacgtatggccgatgctaaagatcctgtgaccggccagactatgggtaaacagcatttcatcaaacaaggtactaacgaatatttgggtggtatcgaatgggatgtttgtaaatgggcccaggtaagtgtcggtatgcaacgtaccaaatatggtgtgggtgataattaccaaagcgatatgagctttgcagttagttcttattcatacggttttggtgccggattcgacattgcgaagaacctgaaactgaacgttgcttatttctggactgattacgataaatataccaaagagactcctaattatggaggtacaggaatctccggaaaggatgtctttactcgtaccaataaagtattcggtatcggtctcgactataagttctgatacaaggcttctactaatctttattaatataactctcaagaaggatcggattactcaaataatccggtcctttttcatttaacctcctatattaagattatctttgtgttctaatcccgaacgatatgagagacacattttttcttttctttgcagcattgagctttgcatgcgtttcttgcagccaggcattaagtaaaagagtggaagatgataatccctgtgtggtgaaattttatttttagccccatctccgtagagtaataacagagacggggctgggttcgtccttggactttttttacgttagagttcagagagatttataaaaagctagaacgaatattgtaccaatgcgttcatgcggttggcatgacgggtattgctactgaagtccgtacgccatcctctcagatattcggcgcctacctgtaagttgctggttacgttccaaaacaggttagctaccagatattggcccttccggtacatatcgggtacatcgcttggatacgtgtgttccgagtagaggcgtgacaaactgtaagtgcccgatacaaatacatctttgctgatgttgtattgcaatccggcgaaccatcccaacatggggagcgtctgcatgcgcccttctttttccgggttaggaacaatatccacattcaggttgctcaagtcgtttaggtattgtccgataccccttccgtaattcacctgtccgtatacttgccatttcggagtcacgttgaaggaagtcgaagcttgaagtccgtatccggcttttgagtgcgccttattgtctacggaacttgaataagtcatgctgcgaacgatggcagctaacttcaggtggctgttggcattccagttatactgtgctgaggcagtgaagtcgggcatacgctgggtgttgatggtgagatactgattcgtggtaccgtctaccgatggcatttcgacaccgacgccgaatttccagttcttcagcttgtcacacatatagctcaattgagtagttcgatagaaagccgagccgttagggcctgcaaagtcgatggtaggaggcagggcggcaaggtccataaagttaccatagctgtatcccagagtaaagccgaggaaggtagcataagcattctgcaactcgaaagtctttccgtctccacggaagtttgcagcagtataaaccacgaagtcacccagacgtttggtatgtcccaccagtttcaggaaaagagtcgaagtgctgatatccatctggaactgattgcgtgcacggtcggcagatcctttattaggaatcagcgccggatagaagtctacatctttcacaattcccccgaagtcatattcggcggttgcccgtacatatccgccgatacccagtgcgaactttccttgccggtcggtcagtacgaagcgtggagccttcggttcctggaaacgcggaagacgcgtctcgttcatgatccggataatctcgtctccggctttgtcggtcgatacaaacatcacggagttcggttcttcatcttcgatgattacttttttctgggcatgtgccgctacaggcaagagtcccaatccgagtagcatagctacagatctaaaaaatgttttcattataagttaagttttaggtgaattgccctattgaacaacttaaatgggaaatggttgaagggccgagggaaaaatcgccaaattatgcggaagaattgctataggacagaccgtttaaaatgcgaatctttgcatattcgataatcagaaagaaagaagagcaatggaaaagatgaatattacccataagatagtggctatgcagcccgaactggaacattttgcctataaactgactgctgaccgggagtcggccaatgatctggtacaggattgtctgttgaaggcattggacaacaaagagaaatttgtgcatacccagaatttcaagggatggatgtataccatcatgcgcaatatctttatcaataattaccgtaagtcgttacgtgaagtggatatgaccgattccacctataatctctatgcgcaaaccctgacggaaggtgaggacggtaaccgctttgaaacaatttacgatctgaaggaactctataaggtgattaatgccgttcccgaagagttgaagaagcctttcctgatgtttgttgccggattcaagtatcgtgagatagctgagaagatggatttgccggtagggactatcaagagccgtctgttcctgatccgcaaaagattacagcaggatttgaaagacttctcgtaagagcgcttattaagattgatgccggattttccggaagtatgaatgggcttttgtaactctgtgacaagagtaaaaagaatagtgtgttaagtgtttgttatgttgtacccggacggggcattacattatatgttatcgcgataacaatatatgtaatgccccgttacatatattgttattttgtcgattaaaaaagaattgctacctttgctgcccgtaaacgtatgatgccgtgaatagcggtcgtgtattctagaacaccacgtaaaaaacaggaattatgaaagaaaaagtatctatacccttcatgttgctcggcattctgttcaacgtctgtctgattgcagcaaaccttctcgaaaccaaagtgattcaggttggcagtatcactgttactgccggattgctggtgtttcccatatcctatattatcaatgactgtatagccgaagtatggggatttaaaaaggcccgtctgattatttggagcggatttgccatgaacttctttgtggtaggtctcgggctgattgccgtggcgttgcccgcagcacctttctgggaaggcgaacagcattttgattttgtgttcggcatggctccccgcattgttgtagccagtctgttggcctttctggtcggttcgtttctcaatgcctatgtcatgagtaaaatgaaagtggccagtggaggacgtaacttttctgcccgtgccatctggtctacggtagtgggagaaacggccgattcactgattttctttcccatcgcattcggcggactgattgcctggcccgagctgttggtaatgatgggcactcagattgtgctgaagtccctttacgaagtgattatccttccgatcaccatccgtgtcgtgaaagccgttaagagaattgacgggagcgatgtttatgataccgacatctcctataatgtacttaaggtaaaggatatataataaggagaacttaaaaacacttttttcaagaaaataaatgatgaaaaatgattcagcagtagttctgttcagtggcggacaggactctacaacgtgtctcttctgggcgaagaagcatttcagcaaagtatatgcgcttagtttcctgtacggacagaaacatgcacacgaggtagaactggcccggggaatagccgaaagggcaggagtggagtttcatgtgatggacacctcttttatcgggagccttggaagcaattcgttgacggataccagcatctcaatggacgaagacaagccggaagattcgttcccgaacacctttgttccgggacgtaacctgttctttctgagtattgccgctgtctttgcccgtgaacagggggctttccacttggttaccggagtttcgcagaccgattatagcggttatcccgattgccgcgactcgtttatcaagtcgttgaatgtcactctgaatctggctatggacgaacagtttgttatccatacaccgttgatgtggatcgataaagccgaaacctgggcattggcggacgaactcggcgtattcgatcttgtacggaacgagacgctgacctgttacaacgggattcctgccgacgggtgcggacactgcccggcatgcaaattgcggaaacaggggctggaagagtatttaagtaaaagaaaccgttaaatgattaatagattatgactgaattgaaagaccagctttctttactgggaagaaagaccgaatataagcaggattatgctcccgaagtattggaatccttcgataacaagcatcctgagaacgattattgggtacgtttcaattgtccggagtttaccagcttgtgccccataacgggacaaccggattttgccgaaatacgtatcagttacctgcccgatgtgaagatggtggagagcaagagccttaagctatatctgttcagcttccgcaatcacggcgcttttcatgaagattgcgtgaatatcataatgaaagacctgatccgtctgatggatcccaaatacattgaagtgaccggtatctttacaccccgcggcggtatttcgatttatccgtatgccaactatggtcgccttggaacgaaatatgaagagatggctgcccggcggttgatgaatcatgaataggggataaccctattcatggtgatagggcccgccgttcagtatggtcatggccctatacatctgttctacaaagatcaggcggatcatctggtgcgaaaaagtcattttcgacatggatatcttttcgtgtgccgcatcatataccttttgtgaaaatccgtaaggtcctcctatgatgaataccaggcgtttgttgacgtttaccagcttcttctccatccagcgtgcaaattccaccgaacgcatctcttttccgtgctcgtccagcaacactaccacgtctcccggctggagggctttgcctatcagttcgccttccttctccttttgttgttccggggtgaggcttttcgtgtttttcagttcgggaatcacctccatatcgaaagaaatgaagtgtttggtacgctctatgtaatcgttaattgcagtgatataatgctgctctacagtccgtcctacgacgataagggttgttttcattcaagtgcaaactcttgtttattgcacaaaaataagaaaaaaatgttgtttttagcattaaatacttacctttgcgtatcgataatacttgtgattatgaaaaaacgggtacttttatggatggccggactcgtattcgctgtaacttcgctcttcgcacaggacataccggtgggcgtggtcgtggcgtttaagaaaggaaactcccaagaactgaacaagtatttgggagagaaggtggatctggtgattcagaatcgctcgacaagcgtcgacaaacagactgctgaagcaacacttgcttctttctttaatagcaacaaggtgagtggttttaatgtaaatcacgaaggtaagcgagaggagtcgagttttattatcggtaccctgaccactgctaacggcaatttccgggtgaactgcttcttccgcagggtacagaacaaatattttataaatcaaataagaatagataaaaccaatgaatgagttaatagacagactgattgatctggcctttgccgaagacataggcgatggcgaccacacaacactttcctgtattcccgccactgcaatgggaaaatcgaaacttttgattaaagaagccggtgtattggccggtatcgaaattgccaaagaaatatttcaccgtttcgatccgactatgaaagttgaggtgtttatcaacgacggtgccgaagtgaagccgggtgatgtggcaatggttgtggaaggtaaaattcagtctctgcttcagacagaacgtctgatgctgaacgtgatgcagcgtatgagcggcattgccactatgacacgcaaatacgtgaagcagctggaaggaaccaaaacacgtgtgttggatacccgtaagactactccgggactccgtatgcttgagaaagcggcggtaaagattggcgggggtgtcaaccaccgtatcggacttttcgatatgattcttctgaaagataatcacgtggactttgccggtggcattgataaggccatcaaccgggctaaagaatattgcaaggaaaaaggaaaagacctcaagattgaaatcgaagtgcgcaatttcgacgaacttcagcaggtgttgaatatcggtggggtagaccgcatcatgttcgataacttcactcccgaaaatacaaagaaagctgtcgagatgatcggaggaaaatatgagaccgagtcgtccggtggtatcacgttcgatacactccgtgactatgccgagtgtggtgtagactttatttcggtaggtgcccttacccattcggtaaagggactcgatatgagtttcaaggcatgctgacattttgaacggtcggcgataaacgttcttaagtgataaacgatgaacaggctacgcattgatgcaaaggcttattcatcgtttattgtttctttaacttctttttgcactattgtttgcagcattcgttgcatccttgcgtctaatagacaaacgacgcagacatacgttcgattttaaaaagacaattgacattggaaaacgagatagaactgataaagggctgtcgggcaggaaaggattcggcccgtaaggaactttataccctatactcgaggcaattgctggcggtatgtttccgctatacgggcgatatggaagcggcgcacgatgtactgcatgacggtttcatcaaaatattcaccaacttctcgtttcgtggtgagtcttcgctcggaacgtgggtgacccgggtgatggtgactcaggcactggattacctgcgaaggcaaaaacggatcagtcagttggtgatacacgaggatcagcttcctgatattcccgatcttccggaaggaggggaggcaggaccgatatccgaagaacagttgatgaagtttgtcgcagacttgcccgatggctgccggacggtttttaacctttacgtgtttgaggaaaagtctcacaaagagatagccgaaatgttgggtatcaaggagcattcatccacttcgcagttgcaccgtgcaaagtttttattggcaaaaaggattaaagaatatagaaatcatgaagagagaaaatgatgaaataaccgatctgttccgttcccgtctcggcaacgccgagatgactgtgcgggatggtttctgggaagaactgaattctgaggtgatggtgcgttgccatcgtcggaaggtgtttttcttccgcgtagcggcagccgcttccgtactgctggtactggctgcttcatcggctgctttttggttcttctctccgaaagaggagatagaagaagcctttacccaggtagcggttgtcagtggaaatgcgactcacctggatggtgacgtggtgaaacaggatttcactcccgtacattccgagcctgttttgagtaaaccgacgcctaagcgtttcggtactctggcccaatatcaggacgaagatgatgattcggtttcggttacggtttccatgtcattcagcttctctgcaacgactacacgcagaggacaaaataatcatccggataaaaactattggcaggccggcggagatggacagaccttagtaaattctgctgatgaatccccgtcttccgattatacggctatgaccgctaaagcccggacatgggctgtaaaggcggcagtcggtaccgcattgcctgccggagatggtaaatataagatgcctgttacggtcggtctgacggtagagaaaaaaataaataaacatttagccgtagaaaccggtttattatattccagtttgcgtgccggacagaacttgcattatctgggaattcccgtaaaactgaacgtgacacttgcggaaatgccgaagttggatatatatgcttctgtaggtggagttgcggataagtgcatagcgggagcacccgataacagcttcaaacaggagcctgtgcaactggcccttaccgcaggagtgggagtgaactataaaattaatgataaactggctttatttgccgaaccgggagtgtcgcaccatttcaagacagactccaagctggaaacagtacgttcggcacggcctacgaactttaacctgatttgcggtctgcgcatgacctattaaccatttagtacggacgttatgaaaaaaacattttttatgctgctcacggttgttttatcattgcttacttgtgtaagttgcagcgaagagacattagattacaataacccggatgtagaccttttcgtaaggcaactcaaagcggggaactataataccaagagcccgaagggctttgtagaagtgcctaaatttacggagaaggatattccggcattgctgaattatgcggaagacctgactcaggttgcttcttttccgcttccgccggtatctgcttactatagcggtaaggtccggttgggcgagtgcatgttgtggatcgtagaaaccattcggttagggcattatgcgtcgtttggctgcaaaatggtgagagccaatgccgagaactacgagggcatctatttcctgaccgatgaagagttacttgatgctgctgcccggtatcgccgctggtgggaaaacaggcagtatcctcgtacggcatggaccattgacgcatgctttgacgagcccctttgcgggagtggataccgttggtggtaaaaaactaaatcagatgaaacgtatcgactttctggtgctgtcttcaggggcggcagtgatcctttatgcccgatgaacagccacgtaaaggaattcaaagacaggaacatgcgaagcaggtactttcatcttattaaataagtgtagaagaatgaagcgtttgatattgtttatatggttatgtccgatggtcctgatagcccgtgcccaatggactgcgaaggattcattgaatctgcaacgcatcctgaacggccaagaggatatcaagctgaatatggatgctgtgaaacagattgatttcaacagcttgccgggtgctcccaaaatgtcgaaggagaagcccggtctgaaattggacgagacgcttccacaagtgcttgatagaaagaaaattgtgttgactctccggccttatacggccaataccaaatataactgggaccctatttaccaaaaaaagatacaggtggatgccgatacgtggcggggagatccgtttgtcgagttttatgagaccgttccttccaactgggctaaaaatgtatacgataaaggtatccgcagttcatacgaggaaatccgttccagtgggttgcggcataatctgtttggcgaacgtgccaatggcaggatggtgactacgcagagcatggtgcatacctctgccatgaagcttggcaaaagtggagtaaccgtgagtggaggcactatcggaggtcttgacctgatgactattttcacaaaagatttctgggacaaaaaaggacgtgaacggagggcgcgtacactggaagttctgaaagcgtatggtgattcgacaacggtgttgcttcctgaaccgattatacattgaatttgttaaaagataaatagggggattcttgccttcttttttcaaaaacgatatgactatgaacagaatttcttctcttttcggtattcagtatcccattattcagggcggtatggtgtggtgtagtggctggaggcttgcttcggctgtcagtaatgcgggtggtttggggttgataggctccggctcgatgtatcccgatattttgcgtgaacatattcgtaaatgccgtgcagccacagatagaccttttggggtaaatattcctttgatgtatccccagatagaggagatcatgaatatcattgtggaagaaggggttaaaatcgtatttacctctgccggaaacccgaagacatggaccggctggctgaaagagcgtgacatcacggtggcacatgtcgtttcttcttctaagtttgccatgaaatgcgaagaggcgggagtcgatgccgtggtagctgagggttttgaagccggcgggcataatggtcgggaggagacaacgacgctttgtctgattcctgcggtacgtgaagccactactttacctttgattgcggccggagggattggtaccggtgaggccatctttgccacgatggcgttaggggccgaaggagttcagataggtactcgttttgctctgacggatgaaagttcggcaagtgatattttcaaggaatattgtttgcggttgaacgaaggcgataccaaattattgctgaagaaactggcgcctacccgtcttgtgaccaattcgttccgtgataaggtggaagtggctgaggcgcggggagcttctgccgaagaacttcgtgaacttttgggcagaggacgtgccaagaaaggcatcttcgaaggtgatctggaagaaggagagcttgagatagggcaggtggctgctctgttccgccgcaggcaaagtgtggacgaggtaatgaaagaattgttggagggataccgcagagcttcggacaaggtatcttcttttttgttataaacggatcattccaccacagggtaacacagagtcttacggagttcttctttttatgattctgctctgtgaaactgtgttactccgtggtattacttgttattctaaattcaattgctcgtatttaagcccgaatacctcagctattgctttatataccactttcccttctaccacattcaatcccaaagccagtgccggatcttctttgcatgcttgtttccacccctttcctgccagtgctgttacataaggcagagtggcattggtcagtgccaatgtagaagtgtaaggcactgctcccggaatattggctacggcataatgtacgattccatcgaccacatacgtcggttcactatgggtagtggggtgcgaagtttcgaaacatcctccctggtcgatagctacatccactaatactgtacccggttgcagcatcttcagcatactgcgggtgatcaggtgcggagccttgtctcccggaatcaagaccgagcctattacaaggtctacgtccggcaactctttcttcagcctcagttccgaagcatataaggtttttacatttttgggcagtgtttcactcaaataacgaagacgggccaggttgatatctgcaattgtgacatctgctcccagtccggctgccatctgggctgcattgctgcctacgatgcctccgccgagaattaatactttggcaggtttcacacccggtacacctcccagcagaatgcctttcccaccttgcggcttttccaggaaacgggcgccctcctgtatggccatgcgtccggctacctcactcataggaatcaataagggtaaagaatggtcagctttttctaccgtttcgtaagcaaggcaaaccgagccgttttctatcatggcaagagtcaattctttatcggaggcaaaatggaagtaagtgaatagcaactgtcccttgcggatcagcttgtattccggtgcgataggttctttcactttcactatcatctgggctgcggcatacgtctcttccatagtgggcaggatctgcgctcctgcggctatatatgcctcgtccggaaaaccactgttctctcctgcggtgtgctgtatgtatacagtatgtccgcgtttcactaattcggcaactcccgagggcgtcatgcccacccggttctcgttgttcttaatctccttaggtactccgataatcataacgttactctattaagggttaaacatggcacaatgtaagaaaattctgcttatgttgttatccttatacggatgttttacagcagaatgatagtagaggtgcaggcacggctctttcatttaacaaccgccttcctcccttgtccccccccacaaaaccttccattcgcacatagcgatgcggaagcagtgcttcgttgtttcttttttaagaaagaatccggccggctattaccggagaagtgtagtagattaaccaatgtcatacaactctttatcctagcccgcatacccgggctgagataaagatccgaccatttgcactaaagagagtaagggaaatgaaatgcttttagagagattaacggataagaaattggatgtatccatttgttttccaaatagttaatactaaaatgttccctgaaacagcgggtggaagatggaagatgggggtggaagataaatggcataaaaaccgcatcttccaccaatctatacatctcacaatcaacgatatgcattctaaaaggtggaagatggaagatcgaaacgtattttttgtatgagaggaaggcgtggtatgaaagagccgtggcaggcaggaataaaatccatctttctgttttctgatatggcaggaataatgtatttttgcaaagattccatttttaagcaaactacatgaaacagtatatagttgctctgatgcttgcctgcagcattcagggacattcacaagatgtgaagcaggctgcttttgttcctccatttgactttacactgactctgagcggtaatttcggagaaattcgtgccaatcattttcatggcggtcttgactttaagactcagggagttgtcggtaaaccggtgcgcgcgctggccgacggatacatctcacgtattcgtgtcaccaatggttcgggacatgtactcgatgtggtatataataacggttatacaactattaaccggcacttgagcggatttatgccggacattgcccgaagagtgaagaagcttcaatacgaaaaagaagattgggaagtagagattgttcccgaaccgggggaatatccggtaaaggcgggacaacagatagcctggagcggtaatacgggttattcattcggaccgcacctgcatctggacttgctggaaaccgctaccggtgaatctgtcgatccgatgccttttttcaaatcaaaaataaaagataccactgctccccgggctgagggcgttatgttgtttccacagccgggaaccggaatcgtgcaaggcagttcggagcggcaaaccttccaacccaatgggacgcgtcccatcgaggcatggggagtgatcggatcgggtatcaaggcttatgattacatggacggtgttcacaaccgttacggtgtgcataccgttgtgctcaaggtagatggaacggaagtgtttcgtagtgtggtcgatcgctttgctccggatgagaaccggatgataaactcttggacctacgggcaatatatgaaatcatttattgatccgggcaatacgctgcgtatgctccgggcttcgaatgataaccgtggattggtgaccatcaatgaagaacgggattacaagttcgaatatgaattgaaagacgcttttggcaacacttcccgctatcactttacggtgcgtggaaaaaaacagccgataaagccgtctgaacatcgggagaagtacttctttgcctgggacaaaacgaactttttgcaagaacccggtttgacccttaccgtccctcgggggatgttatacgacaatgtggctctcaattatgaagtacgttccgacagcggggcaattgcttacacctatcagctcaatgatgagaaagtgccgttgcacggtggctgtgagttgcgtatcgggcttcgtcatcagccggttgccgatacaacgaaatattacgtggctcgtgttactcccaaaggtggtatgtatagtgccggaggaacttacgagggtggatttatgaaaacccgtatccgtgaattgggcacttatacggtaggagtagatacagtgcctcccgaaattattccggtgggcaagaatgtctggggacgtaatgggaaaattgtttatcggctgaaggacaaagaaaccggcatccggtcttatcgtggcacgattgatggaaaattcgctctgttcggacgtcctaacctgacaaaatcgtattgggagtgtaaactcgatcctgaatatgtaaagaaaggtggacgccatacggtagagatgaccgctacggacgattgcgggaacgagacaacggttcgtgaaaccttcgtctggtagctttcaaaaccaaataaccggagattatccgggtaaaacagaaataagatattatattaataatttattatatgaaaagaatctttctctttgtcgctctcttgactgcggcagtggcggaaaccttcgcctgtactaacttaattgtcggtaagaatgcttctaccgacggttcgaccattgtttcctattcggctgactcgtacggactctttggcgagttatatcattatcccgcagctacctatcccaagggtacgatgatggatatccatgaatgggataccggaaaatatctgggacagattgagcaggcgcgtcagacttataatgtgatcggcaatatgaacgagtttcaggtaaccattggtgaaactacctttggcggccgtcctgaattggtagatacactgggcattatcgattacggaagtttgatttacgtaggactgcaacgttcgcgcactgcccgtgaagccattaaggtgatgactgagctggttcaggaatatggatattatagcagtggtgagtcatttaccattgccgatcctaatgaaatatggattatggaaatgatagggaaagggcccggcatacggggagccgtctgggtagctgttcgtgtgcccgatgactgcatctcggcacatgccaaccagtctcgtatccatcagtttgatatgaatgacaaggcaaactgtatgtactccaacgatgtcatttcctttgcccgtgaaaaaggatatttcaacggagtgaataaagatttcagttttgccgatgcttatgcgccgcttgatttcggtgcccgccgtttttgcgaggcccgtgtatggagctatttcaatatgtttaccgatcagggtgaggcttatctgccttatatccagggaaagaccaacgaaccgatgcctttgttcgtgaaaccgaaacgcaaactttcagttcaggacgtaaagaatgccatgcgtgaccattatgaaggaactgctcttgatatcagcaatgactttggtgccggaccttataaaacaccttatcgcctctctccgctgacttttaaagtgggcgatcaggaatacttcaacgaacgtcctatttctacacaacagagtgggttcgtttttgtggcccagatgcgtgccaatctgcctgatgcagtaggcggtgtactctggttcggtacggatgatgccaacatgactgttttcactcccgtatattgttgtactaccaaagctccggtatgctatacgcgtgtagatggtgccgattacatcaccttctcctggaactccgctttctggatttttaactgggtggccaacatggtatatccccgctatgatttgatgatcggcgatgtgcgtactacgcagaacgaacttgaaaccaccttcaacgaggcacaggaaggcattgaagcagctgctgttaagctgtacgagaagaatccggaaacggctgtgaagtttctgaccaactataccgacatgacagcgcaaagcactttcgatacctggaaacgtttgggcgaatttatcattgtgaagtacaatgatggtgtcatccgcaagatgaaggacggcaagttcgagcgtaatgccatcggtcagcccgcaggcgtggtacgtccgggctattcaaaggaattcctcgaagagtatgtgaagcaaacaggagaacgctataaagtaaccgaataattgcttccaaagagttttctgactaaaagataggaatttcaaacttattcttttacatttgtattttaaataaactaattattaatctctaaaatatagatagaaccatggggaatgaagaactaatcaaacaggtgactgagaaagccgaaaagtggctgaccccggcatatgatgccgaaactcaggctgaagtgaaacgcatgctggagaacgaagataagacagaattgattgaggccttttacaaagaccttgaatttggtacgggcggactccgtggtataatgggagtaggtaccaaccgtatgaatatttatactgttggagccgcaactcagggactttctaactatctgaacgcaaactttaagaatctgaaacagatttctgttgtggtaggatacgattgccgtaacaatagttctctgttcgctaagatttctgcggatattttctctgccaatggcattaaagtatatctgttcgaggagatgcgtcctactccggagatgtcttttgccatccgtcaccttggttgccagagcggtatcattctgactgcttcacacaacccgaaagagtataacggctataaagcttactgggatgatggtgcacaggtactggctccgcacgataaaggtattatcgacgaagtgaacaagattgcttctgctgccgacattaagttccagggtaatccggagctgattcagattatcggggaagatgtcgataaaatatatctggatatggtgaaaaccgtttctattgatcctgaagctattgctcgtcataaagatatgaagattgtctacactccgattcatggtacgggtatgatgctgattccccgtgcactgaagatgtggggatttgagaatgtatacactgttcccgagcagatgattaaggatggtaactttccgacggttgtttctcccaatccggagaatgcggaagccctgacaatggctctcaatctggctaaagaaatcgatgccgaccttgtaatggcttccgatccggatgctgaccgtgtaggtatcgcttgcaaggacgataagggtgaatgggtattgatcaacggtaaccagacttgcctgatgtatctgtattatatcatcactcaatacaataaactgggtaagatgaccggtaatgaattctgtgtgaagaccattgttactaccgaactgatcaagaagattgccgacaaaaatcaaatcgagatgctcgactgttataccggctttaaatggatcgcccgtgaaattcgtttacgtgagggtaagaagaaatacatcggtggtggtgaagagagctacggctttctggccgaagactttgttcgtgacaaagatgctgtttctgcttgctgcctgattgccgaagtggctgcttgggctaaagacaatggaaagactctgtatcagttgctgatggacatttacgttgaatatggattctctaaagaatttactgtaaacgtagtgaaaccgggtaagagcggtgccgaagagattaaagccatgatggagaatttccgtgctaatcctccgaaagagttgggtggctcgaaagtgattctgtcaaaagactataaaactctgaagcagacagatgcagaaggtcatgtaagtgacatcgatatgccggaaccatcgaatgtgctgcaatatttcactgcagatggtggtaaagtgtctgttcgtccctcaggaacggaaccgaagatcaaattctacatcgaagtgaaaggccagatgggatgccgcaactgctttgccactgccgatgcagaagctactgaaaaagtggaagctgtgaagaaatcgttgggtatttaagaaacttctttaagtactcttttaacagatactttgggtaatataaatgtgtccatagtattatagtattatcgaaatgccctgtcctgaattggatggggcatttgattttctatcgaatgcaagccgacagttaagcacttgtgttctggcgtatcgggctgtgttgtgaattgttttttaatcacgcttttttcattgtgctttgtttattcggctgaagtgtagttattatatttttacggtacttttggtagtagtccaaaaatttttagcttggaggtgctgcctgagacacttatagaactgctgtgtatgtcaaccttgcgactataaatgatgatatatccatggtattacttagaatacaaactcttgcgtttgttcttcatcttactaccaacctaatcgatatttaaaagggctattgagatatggctaatagaaatatagtcttttctgtcagtgagtttactttagagggaagtggtgtgtaaatctattttttcaggagtatggactctttatcgtaaaaagtgattgatgtgttaataatatacaagcaaagttttttgtaaattataaataataattagtgaatttgttattataatatatgatattatatattaaaatgtttttaaatgttctttgttttataattaatttgtgaccttcgcacatcaaagatacacaacgaaatgaagaagtcttgtgcgatgttaatgaaaatattttagaaccttttaattctatgtaatgcatattaagaccaatccgaatgataaaatgtcttttaatcagctatataatgattatcagacacggtttgtgaattttgctaatacctatgtcagagattgggatgtagcggaagatataacgacagaagcgttaatttactattgggaaaacagaaatactttatctgaagtatccaatattcctgcatatatacttaccatcataaaaaataaaagtcttaattatcttcgtcatttgcagatacgagaagaacattctgaaaatattagaaaatatattgagtgggaactcaatgcacgtatcgtttctttagatgcttgtgaaccctatgaacttttagtcaaagagatgcaagagttgattcagcaaactttggataaattgccggaacgtacacgcaaaatatttattttaagccgttatgaaaacaaatcttataaggagattgctgctttaatgaatatgaccaccaaaggtgtagactttcatatttgtaaggctttaaaggcattacagattaacctaaaagattactttccattatttctttattttttgatgaaatttcactaggataccttttccatgaagtgccttatacataaagggacattaatacattgtcatggacaaagatttactatataatttttataaaggaaaggtttccatagaggaaggacaaagggtcaaggcttgggtagaagcatcagacgaaaacgaacgtaccttttatagggagcgcaaaatttttgatgccttgatgcttaataatccgcttccggtaaagaaaatctcttttttcaattttacacataataaaagaatagagtggctgaaaattgccattgctgtaatattgacacttctgcttagttatttctatcaggagcataaagccgatctggattcaatggcaatgaacacgatttctgttcctgaaggacaaaggaccaatgtcatattacccgatggtagtaatgtttggttaaatgcatgtacaacgatacaatatccgacttcttttaatagccgggagcgtttcgttatactaaaaggagaagcttattttgatgtgaaaaagaataaaagcaaaccgtttatagtgcacacagatgcctatagcattgaagtattaggtacaaagtttaatgtagatgcatatccgggaacagaaaaatttgaaactacattgatgcatggtagtgttaaggttactttgaaagcagattcgtcgcaaacagtaatattaaaacctgatcataaattgtcattagaaaaaggacggttcgtaatgactaaagtggaagattataatccttatcgctggaaagaagggcttatctgtttctctgacgaatcctttcctactattatgaaagactttgaaaagtattacggagtgaaaatagtgatagagaataaaaatgtattgcagattaattttacggggaaattcagacaaaccgacggaatagattatgcacttcgtatcttacagaaaaatatagatttccaatatgagaaagataatgaaaaacaaattatctatataaaataaagtattaattcttaaaagcgaaatgcctatgaaaaatgatctaagttaacctattgaaaatgccgataagtgttcccgcacctaccggcataagaaatcaacacaattttttattaaaaatgtatcaatttaaaatctatacaaaggtatgaaaaataacactttgtcggggtcatattaccctaaaaatccccaaataaaacatttttttagaattatgagaattacattattcctattgatggcatgtgttttttctttgtatgccggaaattcctattctcaaaatgcaaaagttagtcttgccatggataatgtagggctaaataaggtcttagaggcgatagagagtcagactgattatctttttatttataatagtcagataaatgtcaataagatagttactattaaggcaaataagcaggccgtttcaaaggtattagatcaaatattacagaatactggcattgaatataagttggaaggctcgcatattatattagagaagaaaacagaagaagtgcacaataattcatctgttgttcaacaacaaactaaaaagatagctggaacagtggtagataagacaggagaggccattattggagcgaatgtcaaaatacaaggtacagataaaggaactattactgacctcgatggtaatttcaccttggaggttgctccaaaggatgtgcttattatcagttatataggttatttggatgcaaaagttcccatagccggacaaaaacatatccatgtggcgttgtctgaggataataaaatgttggacgaggttgttgtaattggttatggaactacttctacacgcaagatggcatctgcggttacagccgtgaaaggtgagaaattgcaggacctgccatttagtagcgtaacagcttcactggccggacgcgcaacaggtgttattgtacaatcatcaggtggtgaaccgggatctaccccttctatctcgatccgcggtggtggtgcacctgtctatgtcatagatggtgttatttccgatgcatgggatttcaatacgctgaatccgaatgatattgaaagcctttcaattcttaaggatgcagcatctctggctgtttacggttcacgagctgccaatggtatcgtaatggtgaaaaccaagcagggaggtaaaggaaagacagcggtaacttatacgtttaacgctgaatttagtcaacctactaaattactgaagaagacccgtggctatgactatgcttacaatcaaatgcttgccggtatcaatgatggtttggacgaggcggacttgccttttaatcaagaagtgttggatatcattaaaaatcagtcagatccttatacgtctggacatgctgatacagactggttgggagaaggattgaaaacttttgctcctcaatacaagcatacagtatcattaagtgggagtggcaataaggtgaattattatatttctctgggcatgcttaatcaaggtagcatctatacttcggatgcattgaactatgaccgctatacagttcgcagtaatgttaacacaacttttgacaagattggtctgaaagtcagcctgaatctgaacggagcttatgaaaaaaaggaatacccttccttctcggccgcaaagatctgggaagatctttataaccagtctccgttgaatccggcttacaataaggatggtacttatgcggcggttaccgaccatccgttggccgaaatggacaagcgttcgggatatgacaggaactatggcaaattcattaatacgcaactggcggcagactggacattgccttggttaaaggagttaaccttgggggctatgttcaactatcgtctgaacgactcacatgtgaagaaattcagtactaaggctcctcagtattacgcagatggatctatatatccaataggtaaaccgacattgaatgaagaaggctattggggagaatcctataattttgaagtaagtgccgcctatgtgaaaacctttgccgaaaagcatacgattgatgccaaattcgtttataatatagctgaaaatactggatggaattttaatgcatatcgtggggaatacttatctacagttgtggatcagctatttgccggtgcggcagatacgcaacagaatggcggcaattcagatgaaggaggacgtatgggattggtcggccgtttgaaatatgactttatgaatcgatatatagtggaaggtagtttccgttacgatggatcagataacttcgcaccaggacatcgttggggattcttcccttctggagcagtggcgtgggccatcaccgaagaacctttcttcaaagagtgggatcagcatgtattcgacttgctcaagctacgcgcttcttatggacagactggtacggaaaacggcgtaaaccgttttggttatctttctacttatagtctggatgagaagaaaattgtggtcggggggaaattgcaatcaggatttagcgaaggggctttggtgtctccggagctgttgagttggtatcaggtcaattcttttaatctgggattggatatggctttcttcaacagtcgcctgaaaggtacttttgattatttttattacgtaaccaaaggtggtttgatgagtccgggagaccgttatacaactcctttgggtaaacctctgccacaaataaaatcaaatagcgaacaacgtcgtgaaggtgtggaattgacaatgcgttggtcagatacgactccacgtaaattcgcttatgaggtaggattcaacatgacttactttaatagcctgtggaaagtcaaagcggatgaagcattgtctgacctgatgaatccttacaaacgccagacacatcagaccgattactatggattgggatatatagatacagggctctaccaaaacaaagaggatattctgaattcccctcgaagattgggatctacccaaactaagctcggagatattggctatacggatgtgaacggtgatggtaaaatagacggtgaagaccaggtacgtatcggaaagccgacaatgcctcactttacttatgcctttgatttttctttgggctatgaaggattcactttgtctggtttattttatggaacaggtgaacgctacatgacccttggtaatcgttatcagacaggtgaagggaaatacctgtattatgaaaatcagctgaactattggagaccggacaatacaggtgcggattttccaagaatttcgatcagttccggtgtgaatggaaataataataaagcaggatcgactttctggatgcgaaatgcatcgtatcttcgtctgaaggatttgcagttgagctatgacttcaaatataaatacctgaagagatgcgactggttgcagacgtgtcgtgtaaatctgagtggtagcaatctatttactatttcaggtgttagcaaatttttcgatccggaaacatcgagtaccagtggcgacggatatcctgtacagcgagtttattcaattggtgtaacaataggtttttaatagggaggaataaatatgaataagataaagaatttatttgtaattatgctatttgccttggtcgccttttcctgcagtgatatattggacaagggaccacttgacaaatattcggagaatgatgtgtggaaaagtactgacctgacacaagcattcatttatactgcgttggccaatgctacgaatatgatggtttggaaagataattggactgataatgaggctattctggaagatgggcgagatgtgaatgcagaattgatagaccgttattatgatgcgggatggaataagtatgaagatatccgtcgttgcaacatggtgttggcacgtgttccggaagctccctttacaaatgcagaaaaagctaattttatagcacaggctaagacgatacgtgctatgatctattttacgcgtgctcgcttgttcggtaaactgatgttagtgaaagaacttattgatccggaagcggatatgaagttccctcgtacggctacagtgaaagaaacttatgatttcatactgaatgacctcaaggaggctgctcctgatctgcctgtagatgctccatcgggcgcactatcacgcggtgtcgcctacgcattgttgggagaagcagctttgcatggagctgcatacattgaaaatggacaggaagagtattacaggatagcagcaaaggcctgtgaagatctgtttgcactggacaaatactcactggatggtgactacgctggtattttcaatgattacgatcattcattggtttcaagcgagataattctggcacaatggagaagtgctgaaaatacgaatttttcagatacttggatgcagagactggttcctaatattgatccctctaaattgattgccgatgtgcaggcaaaatatcctttggtagaggagatggctggttggccgcaaagatttccttctgttgatttagtgaatgattatcttgtagttgatgaggatggaaaagccaaagaatgggaccagacttcttattatcggaaattcttggctgacggaggaacagttgaagatgctatttacaagaatcgtgataaacgattcaaggcttctatcgtttacgacggatgttcttatttcgctaatagggtgtggcttcgtgagggaggtaatctatattatacttccaaaacgacagaattctgggggatgccggtatcaggatatgtttatcggaaatgtgtttatgaagccaagcgtttgctaaacacggagaaaacgaattatcattatactttattacgtttgggacgttcttatctgaattatgcggaaatcaagttgcggcagggtgataaggaaacggctattgactatatcaataagacgagggtgacccatggcggtttgccggaattgcaaaaatccttatcattggaagaaacctggaaagagtataaacgtgaacgccgtatagaacttgtcaatgaaggcgaccgatactggagtgtacttcgttggggcaaggctgacggtctggagattgttccggaactgacagttgaacagaagttcatgaaaatagctcctgatggaagatcttttgagataattccactacccatttaccaaagtgataatgagcgtactttcaccaagaaacattatttattccctgtaccgcaaggagaacgtgatctgaatccaaatctggaccagaacgagggatggtagaaaaatgctgacgtctaattattaaagtattacgaatatgaagaaacttataaatactattttgttaatatttctaataggtacagtttcatcgtgcctgaaatctggattggatgatttggaggcctataatgaagctgaaattactaatttgaactttgaatatcgttggtgggatgaggctaagaatcagatggctgttaaaacactcaacattgaaaaacaaatttcgaaagacgataatctgattacctgcaaactaacggttccaaccgccagtggcaactttacagatgctgtcaggcaaaatgtatcattaagtaatcttattgcctatatggatctttctactgctgccaggattgcgcccttgaacggagctcctaaattgggtactcctggcgatttctcagctaaggagtttaaatatcaggtgactgccgccgatggtacgaaaaaagaatggacaataaagattacggattttgtgaaataagaataactattgaagttactcggattactaattgaaatggggagggaagatatttgaaaaatatcttccttcatctgttattatattatattagtgaaattaataaaaagaagaactatgaataaaccctatttaattgcatttctactctctttagccttatggacagtcattccttctgcttctgccggagatgttatttttaaagtatttgaagggaaaccacgtatcaattctcctcagattacaggtaattatccttcaactccatttatcttttatattccgacttccggtcagcgaccgatgcgatggagtgccgaaaaacttcccgaaggattggaagtggattcgaaaactggtattataagtggagtcgtgacctccaaaggagattatactgtgactctcaaggctgagaatgcattaggtgtaagtgtgaaacaaatggtcatccgtattggtgatgaattactattaactcctccaatgggctggaacagttggaatactttcggacagcacctgactgaagaattgatcttgcaaacggcggatgcgatgatagagaacggaatgcgtgatttaggatattcctatattaatatagatgacttttggcagttgccggaacggggggctgacggacatttgcagattgataaaactaagtttccacgtgggataaaatatgtagctgattatctgcacgaacgcggatttaaattgggaatttattcggatgcggccgaaaaaacttgtggtggtgtttgcggtagctacggatatgaagaaacagatgcaaaagattttgcctcttggggagttgacttgttgaaatatgactattgtaatgctcctgtgggtagggtagaagctgtggaacgatatgcgaagatgggaagagctctgagggctaccaatcgttcgattgtctattcaatttgtgagtggggacagcgtgaaccttggaagtgggcgaagcaagtggggggacatttatggagagtatcaggagatatcggtgacatctggtatcgagatgcaaaccatgttgggggattacgtggtatattgaatatccttgaaatcaatgctcctctgagtgaatatgccggtccatccggttggaatgacccggacatgttagtggttggaatagatggaaaaagtaagagtattggttatgagtcggaaggatgtacccaggaacaatataaatcccattttagcctgtggtgtatgatggcttctcctttactttccggaaacgatgtgcgcaatatgaatgatagtacattaaaaatcttgttgaatgctgatttaatagctattaatcaggatatattaggtagacaggcagaacgaagcatccgttcggatcattatgatatttgggtcaaaccgttggcagatggacgtaaggctgtggcttgttttaaccgggcaagttctccgcaaactgtgatattggatgaaaatacgattgccgatttgtcattcgaacagatatactgtttggacaaccatttgacaaagagtggtagtgattcaaaggaactgatagtgaaactggccccttatcaatgtaaggtctatattttcggtaaaacgaattgaaatgtactagtttgttaaatatttaattggcaattatgccgcaaatataattctcactttccattgctttcgatttatttcctaaactgggttaaatgtccaacacggagataaatcgttgcatgagaaagctgttgtgctgaacttctttcacagaagctattttaagttcgtgtcagttgagaaatgcaacttgcacattttcccatttttatctttcccggattcatcatgataaagaacgatttgaaccgaatggtccaagtttatttgattttgaattagcttcaatcttaatgtgatattatctataagataaactatcgtttttaaagctgatcattgcgtggaacgcactctttaagtaataggcagactgatgggatatctgtttgaacttgccaaattggtaacctcacctcttttaacattttatcttcttcgtcttcttttgctttctttagggagtaaggggcaatcattcttagggatatattgttcttacagcaacatctaaacttaaaaacgtatgaaagatcttgtgtccggcatccggtatgatgcctctaatgtgattagtcaggctatagggccaagtaaagaattttgcatgggatatttaaatcccggcgttgtgggtggtgaaggatatatttcgactatgaaattgtcagtcggtacagtcaacgtgaaagacctcgatgcaataaccgaaaggattgtagcaaaagatcgttgtgagaagaatgacgcgtatctcgggcaagtcaatctgatgaaagcttcttctttttgcggacagaatggagctatttggggatttgatctggcgatgcacgatgacattgccaaaagaaaagaaatgcctatctatatgcaggcgcaacccgatggagtagacatccctgtttataatatccgtccgttgctggaggcaaccgaacgtctgttcggccgtgccaaggagcgccgtttccctgtgcttccgggagcttacgtaccgggaggaagcagaaaagttgtggcgtgcggtcccgtatgggtatggtctgtaatcggcctggccattctgaaagaccgtagtaaaggagcttgcctgtttgtaaaagatgcaggcacctatggagacgattcgacaacagaaggtgaagccatcggttttttggaaggcatactccgcaaggcaaccaatagtattgctctttgcggtgaagatcaggatgtgatctacgaccgtatttacatcggttataagtatacatttgtagaacccggtcaggtaggttgtgccctgtcgtgcactcctgccgtttatatggcgcaaaatgctattcctgccgatatgaaaccggccgatctttgccagatgactatcagtgactgggaagagaagctggggctggaagagttgacgatctttgaatagaagttttgtaatcaaatacaagctacggacaggtacacaggtttatgatcctgaggacgggtttcttttctattcgtccctggttgttcgtttgtggtaggtgtaccttccgtagcttgttctgtttttactgttgtgcgatccaccagtcgatcatcttacgtgccaggctaagtttgcggggaagttccggcaagtgatccctggtatagaagttcccggagctgagctcgtcatcttgcaggtggatgtcaccaccggcgtagtcggcgataaatcccaccatcagtccgctcggatagggccagggctgactgccgaaataacggatgtttttcacatcgagcccggtttcttcttttacttcccttaccacacactcttccaatgtctcgcctgtttcgaggaatccggctaccaggctattgaaagtacctttaaagttgcgggcatgtatcagtaacagggagtcttctttgcgcaccaataccaggatggctgttgagatgaccggatagatttctctgccacaattcgggcatttcttcataatgggttctttctgtaccagcggagttccacaagtggggcagtaacggttgctgcggtcccagtagagaatttcgtgaaccttgcctgcggcctgatagtgttcctgcgacaagtaatcataagaagtgcgcaatcctatctgcacgtattccggagtttcggctatcggagagtcggtgtagaaagctttgcataccatacccgttgccgtggagatggtgtgtacggttgttcctttcggaatggtgacaggggcattctcgcccgtggggatggaaaaagcattgtcgttcttttccaacagtaactgatcttggtaaaagataaaccaccagtagttggtttctgtatttatcatttgggcattattctttttaatcggtgcaaaattataaaaagatactctttttgatgccggtttcctttacaaaatattcatcatgtgatacaagcagtacactgcccgtataattccgaatggtggctgtgatgatttcgatattttgtatatccagattattggtaggctcgtccaggataaagaggtcaggcgtgttgttactaatcatcaggcagcagaaagcgagtcgcattttttcacctccactgagttggatgcaaggttgatcccagctcgttgccgggaagagaaagcgattcaacctgatttttatttcgtgctccggcagggcacgtacattgaatgattctgcttgttgaagcaccgtcagctgattgcagatgatggaatattcctgattgagatagatgtaactgaacgcggtgcgctccagtgtgcccgaagcaggcaatagttctccggtgaccagttttaataaggtagttttaccactcccgttgtctccttcgatacgtatccggtcaccgcttttcagttggaaacttaggggagccttccataaaaacgaaatttcataagtgaagtttatatcacgggcagtcagtaatatttttcccggatgtaaagccgaagcgttgaaatcggttttaagcagtgacacttcggccaacctgttgcgtatctgacttcgttcggcggcaagtttttccgatttgtcccggtggatgtctgccagtttagtggtacttttttctgcccggtctttcagggtattgatggccatgcgggaaaggcctttttgaaggaccgttttttcgctccgtacattttgcttgtcttttcgttcggcaacctcacgtgccaccttccgtacttgccggagttctttctccttttcatccagttgttgttgcaaagcactgagcaaaagctctttctgctgtttgtagaattcgtagttccctccgtaaaacacaagtgtgctacggctcagttcgcaggtttcgggaagcagattgagcagagtacggtcgtggctgactacaatcagcgcagaacggcatttcttcacccattcatacagtttgttgcgtccttggctgtcgaggtgattggtcggttcatccatcaatatcacggaagtttcctgcagttccatgcctgttaggaatacgcgtgtcttttctccgccactcaatgtatgcatgggctggtcaagagacattgttccgagcccccatccattgagagctgctgtggctttttcttcaatgttccagtcgtcatcgaggatattgaagttgacgatggaagtatctccatccagaatggcatggagggcttttcgttttccgtctatcccgagggcttcggcaatgctcattttatcatattgtccgaagtgctggggcacataataaggggcggatggacggagtacggttcccgaacatggttgcagttgtccggatatgatttgtagcaatgttgacttgccacaaccattattgccgatcagagccaattgctgtcctttgctgacagagaaactgagattttgaaaaagaacttctttatcgggatggatataggtgatttgttgtacttggatacacatacttgtctattggtttgaaagtaaatatttgctgttgatgatagcaggtaggggagagacaaacacaataggggttaaacaacacggattcgtgatgcttaacagtacatgaaaagaagcatttgggaaaagtgatgtttaccggaaggtgttgtcttacttagatattctcatggccatatgtatgaaattagatcgcaaagatagaagatattccggcaattacaaaaagagaggggagaaatctgaaacttctcccctcttctcgttaaactaatctattgaaaacaattcattcagtccttcgcccatacttggatgtgtaaagatgaaatcgcgaaggaaggtataatgttgtccggtcttcatcgccatgtttactatgttaatgacttcggaagattcggcacagaacagcgtgcagcccatgatgcgtcccgaatggctgtcgacgatggctttcagtatgccgtcagtctgttgcagcgtgcgtgcacgcggcagtgcagaggccggaaggcgtgacaccttgaaggaatatccccgtttgatggcttcttcctcggtcagtccgacgtgtgagagaggcgggtctataaataccgagtatgccaccggattgcggtcgtcggccgtgcgttctttgttgccgaaaaggtcgtcccggataatccggtaatcatccagcgaaatataagtaaactgcaacccgccttttacatcacccatcgcccagatgttcggggcagtggtatgcagataaccgttcacgacgatagctccgtgactgtctacttcgactccggccgcttgaagattcagaccttcgatcatcggtttgcgtcctgtggctatcaggatggcatcgccttctatagtgacgggttttccgtcggctgtatccgtgtaagtcagcgtcacgccgtcggctgtgtcttgtatggattgggcacgggcattgaggcggatttctatccctttcttttcgagtgtttccttaacggcatccgctatatcacggtcttcgcgggcaataaacttatttcctccttcgagcacggtcactttactgccgaagcttgcgtacatcgaggcaaactccaggccgatgtagccaccgcccacaatgatcagatggcgtggcaatacgtccagttccatcagtgaggtgctggtatatacccgcttgctgtctttcagcccgtcgatggccggtataatgctggtagagccggtattaatgaaaatcttctttccctgaagttcgatcacttcgtcggggagggttactttcactacatcctttgaaacgaacgatgccattccggtatagatggtcacgttgggaaggctgctcagcttattgaatatattggcccttgaagctgctgtcatctcgttcttgcgtgctatggcagctttgtaagcctcagcctgcttctcgtaatcggtaggatagagccaactcaccttttcggcttcgtggataagccgcttggtgggtacgcaagctatattggggcaggtacctccatacatcatagcggaacgttcaatcagtgcgaccttccagccgcgtttggctaattcggcagtcagcgttttgcctcctttgccgaaaccgataataatggcatcatattgtttcataattcttattacttttaggatgtatctttatgtaagtttataacattccgcaacccttatttgtttcgcttttcccagtcggctttcttcaatgaattcagtacacgttgtgaggagtcggagagtagggtaacggcgcttgccagaattacgatatctttaataaccagacgtccggcaccggacagtaaggggaagccgtattctccgcttcccaggttcggaacccagacttcgggagtagtcaccaggaaggagagagtgccaagcgtcatgatgatggccagtgtgtcgcccacaagtgccactttggggaagaagatgcctaagaaaaccagaatgccgatggacataatcaaagctcccagtccgtaagagaacgtgtaggtcctgttcgcttcgtgccattcacggttggcggggacgtatgcgccttcgggatttttgtgctctttatactcgggtgcgtctttggcatagaagaaactcataaacggactgttggctacgaacggaacaatgccgtcggcttcataatgaaaatacttcaaaccgccgatccatacgaaaacaacaaggatggctacgcggataaactttagtccgaaacctttcagaccggatgctactgtgagcagagtgataaatttctctttcatgctatttctttttatgggtttaactttctgatgcaaagatcagggttttcccatcggtgcgaaatagcaatatcgccgtatgaattgtcaattcttcccttctaccgaatttcggtattgtacggggctttctcccgtcatatttttaaagaaacggctgaaggaagactggtcttcgaatcccagtatgtcggcaatctccttcgaacttttattactatataaaaggagtcgcttggcttccgcttccacccgttcgtggatgactcgcagaggtgatggcaatttacaggaagaaaagatgttcgaaagggttttgggcgatttgtgtaacaagtcggcatagtcctgtacctgcttcttagttcggaagtgttcgtccactaagttataatactggcggatgatttcgaagctgtattctttttcctgggtaatgttcagccgttggcgggcaatacgcgtgctttggatgatgaaacgtttgagcaggatgcggagcatttcttcctgaaggttgtccgaaacggtgaactcacgatccagcaatcccactacgtcttccatcgacctccgttccgattcgttgagcatgaaacgaacgacatgcgaagaaccgttgaacaggaatccgctgcatgacacttcgtggtcattgccgtaaatgcaatagaagttactgttaaacagaaccgtcaggtactctccgtcgatcgaaagaaattccaggtgctggaggttggaaagggagatgacctcgttctcggccagtatcacttcctgatggtctatctcgagggtgatgcttcctttgcgtacccagatgaatttatataaactcttttctttctgcaagttcttttcggtgtgatagctggtagtcagtgccagcatacctttcagtttggtctggtaagttcttatcataatcaatcctccatggctgatgcgtcaaatgacaggggtaataaatgtccgatgctttgtacttcgtagatacacttcttgccataaagcaatatacggatgggctgtttatatcgtttctccgtttccagaatcacctggcgacaagcaccgcagggcgggatgggagtgtcgataaaatctttctcggtacgtgcggcgatggcaagtgtcaccacagcctggccggggtactgtgagttggcataaaatagcgtggtgcgttcggcacagagtccggacggataggccgcattctcctgattggttcctgtcactaccacaccgttggccagcagtgctgccgctcctaccgagaagtgcgagtaaggcgcatagctgcgccgggttgcctcgatggcgtcatccaataaggcacggtctgtatcattgagttcatcatattcatatactttgattacagaggtaatagtcaggtctttcatgtgcgtaggtggtttatagttctacaaatcatgttacaaagttagaaaagagattgataatcccaattatttttatgatttttgtgccgcataacctaacatacacaaattatatagatgaatagcaaacttctcaggctgattgccgtagttacagttcttgctttttctgtcggtgcccaggcgcagcgcaggaattcccgttacgtagattatataaataagtatagtgccctggctgtagagcaaatgaaggagcacaagatacccgccagtatcacattggcgcaggggctgcttgaaagtggtgccggtatgagcacgctggcgcgtaaaagtaataaccacttcggcatcaaatgcggtagtagctggaatggacgtaccgtacgccatgacgacgatgcccgtaacgaatgcttccgtgcttatcgcaatccccgtgattcgtacgaggaccattcggcatttctgaaacgcggtgcccgctatgctttcttgtttaaactgaagataacggattataaaggctgggcccgtgggttgaaaaaggcgggatatgccaccgatccttcgtatgccaaccgtctgattacgattattgaagactacgacctttataaatatgaccgtaagggaggatggagttcgtcaaagagtgaaccgacggtactcaatccgcatcaggtctacatagcaaacggtatcgcttatattgtagcccgtgacggagatacgtttaagtcgttgggtaaagagttcgatatccgttggaagaagttggtgaagtataacgacttgcaacgtgattataccttgatggatggtgatatcatttatctgaaagagaagaaaaagagagcgtcgaaaccttatacggtttatatcgtcaaagacggagactccatgcataccatttctcagaaatatgccatccggttgaagaacctgtataagatgaaccgtaaggacggggattatgttcccgaagtgggagacaggttgaggctgaggtagactttgccgctgcggtatataagaaatgtattaatagcaaaagggtgtagccatactttatgcatggctacacccttttgctattagggctacaccctttctgccggatggctacacccaaacgtgtgtttttcaccgcagagaacacagttacgttttgttacgaaactgtacagggtgttcattatcggacaccttgtttctcttcttcctgctgaaacacagtactttccttttttggcataaggtttgatcatagaaatacaaagaatatttgtaaatctataattgactatatatggacagagaaattccaaaagaggtgcgcaataaagagcgtaataaaaagattattcgtttttcggccatcggtattatcgggatagtaggcattagcttactgatttcgttgttgcgtacgggagtacagaagaaggatctcgtgttgtctaccgttgacaaggggacgatcgaggtcagtgtcagcgcttcgggcaaagtggttccggcttttgaagagatcatcaattcaccgatcaacacccgcatcgtggaagtatatagaaagggcggtgacagtgtagatgtaggcactcccatcctgaaactcgacttacaaagtacggaaaccgactataaaaagctactggatgaggagcaaatgaaacgttataagctcgatcaggcgcaggtgaacagccagaccaaattgagcgatatggccatgcagatcaaagtgtcggaaatgaaactggcgcggatgaaggtggagcttcgcaacgaacaatacctcgacagtcttggagccggtacgactgataaggtacgccaggccgaattgagctacaatacgtcccgcctcgaattggaacaactcaaacaacaatatgccaacgagaaacaggtagcagccgctgacctgaaagtgcttgaactcgacctcaacatgttccgtaagggacttgccgaaatgaagcgcaccttggatgatgcgcagattcgttcgccgcgcaaagccatccttacttatatcaacaaccagatcggtgcgcagattcctcagggagggcaggtggctatcatttcggatctgagccatttcaaagtggatggcgagattgccgatacttatggcgaccgtgtggcagccggtggcaaagccattgtaaagataggcagtgagaaactcgaagggaccgtaagcagtgtcactccgctttcaaagaacggggttatctctttctccgtgcaattgaaagaagataacaacaagcggttgcgctcgggactcaagaccgatgtatatgtgatgaatgctgtgaaagaggatgtactgcgcatagctaatgcctcttattatgtaggtcggggcgaatatgatctgtttgtgatgacttcggatgatgaaatcgtaaaacggaaagttcagttgggtgactccaactttgaatttgtagaagtggtgagcggattgaatccgggtgacaaggtagtggtcagcgacatgaccaactacaaaaataagaacaaactcaaagtgaaataatctgctgatttttttttaaaaatcaaggcaccttagggttggaactaaaggtttgttggttttaaaccaacggaattttggtttaaaaagtagattgtgtgccttttaagatgcgaaactatgataacaatttatctcaaacaatcttataatttgctgaaagagaaccgtttcgtgaatggaatctctgtggcgggtacagctttgtcaatggcagccgtgatgcttatttaccttgtctatcaagtaaattattctgcgtatgcacctgagtccaaccgataccgcattctgtttgtaaatagtctgcaagcgtgcggaagtgatggaaaccctatcaataacggagctatgagtcataaggtggtacgtgaatgtctttatcctttgcaggcacctgaggcagtgactgcttttactgacaaacaacttccggtcaatatacgcggacagcagttttatgataaatatacgattaagtttaccgatgacggtttctggaaggttttcgatttcacttttctgtctggtgccccttttacacatgccgattgggaatcgggtatgcgacaagcggttatttctgataaactggcacgtaagttatttggtacggttgaagttacagggcagactttgcgtatgaattatgccgattatcagatatgcggtgtggtgaaagaggtgagtcaagctgctgaaaacgcttatggagatgtgtgggtgccctatacggtcaattcctccttattaaaggaaaatgttaactactgcgaaggaactacaggagaatttacctcctgcatcctggcacgttcttcatccgacttcgaacctatccgcagagagatgttgaagttgcaggccgctttcaatgcttcgcttaccaacacaaaacttgactatatgtattctccctatacccagtggcaggccgtgctgggtacaaatggtttcgatcggggtacagtgggcgaatggtttaaaactaccggtgcgacggttcttttccttttgctcctgcctgccttgaatataataggtataacgctgacacagtttcgcaaacgtcgcagtgagattggggttcgtaaagcgttcggtgctcgttcgttttcgctggtagagcaagtgatgaccgagaacctgttgatctcctgcataggtgggctgatcggactggtgttgtcatacgccttgttatctctttgcaggtcgtttttcttttcgggaactattgctctgacacacgatatgctgatacagcccttcacttttgttgcggctttctttttcacgctgttactgaatttgctgagtgccgcgatccccgcctggcgggcctcacggatgcctattacagaggcgttgcatgatatggaataattttaaaaacaaagacccgttatgataaagcaaatatttaagataatatggaaccaacgccgctctaacggttggatatggatggaacttctggtcgtattcgttgcgctgtggtatctggtagatatgtttgtggtacagttctattcctattcccgtccgttgggctatgatatcacgaattgctggcggctttcgtttgatgtttatcccgaagatgccgccgagtatgtcagcgacactactcaggctcctaccgaaggcgaagcattggcccggatccttgaacgcctgcgtcgtgccccggaagtggataatgcttgtgttgctttctattcctcaccctattccggaggtaattcatggacacagatcatgccttgtacggccgatagcggtaagttcaaagagcaatcctatcaccaatataccgtttctcccgaattttatgatgtatttcgtatccggagccgtgagggacagcttctgagtgaattattgaacaaaaaacagttggaatattttattactccggatctggaaaaagatttcttcggtgaggagtcggcagtaggacagaaagtatgttatcccggcagtagtatgcgggagatacgcattgcggcagtgaccgtcccggttcgtatgaccgagtttgtgaagccggagcccgaacttttctttactatgagaccgaaagagctggaacgtcaggtgaatgcttccggggtagctaatatggagataaccgtgcggatgaaagaagatttgactccggaacagatggggactttcctaaaccggatgaagagccagttgacggagaataatctctacgttgccagcatgaaggatatgaagcaacaacgcagtgaacgattgcggtctgaatggcggaaaatcagtattaaccttctgttgtccgttttcatcttgctgaacgtgcttttcggcattacgggaactttttggctacgcatcgagcaacggcgtagtgaaaccggtctgcggatggcactgggcagtacacgcaggcgggtaggatggttcttcactgccgaggggtggttattgctgaccaccgtaactccgctggtgctgtttgtcatgttcaatatgatacacatggaaattcccgatttgtacaatcttcctttctcctggtggcgttttgctgtcggttttggtggggtactgttgctgatggggctgatcattgcgttgggcacgtggttgcctgcccgtcgggccatgaagttgcagccggcggaagcgctgcattatgaataataaatttagtaccgaacagacatgataaaactctatttcaaacaatcgtgggcgttgatccgccagaataaactgtttagcagtctctatgtgctgggtacagggctggccattgccatgacaatgattattgtcattgtgtattatgtaaagatcgcccctatctatcccgaaacgaaccggtctcagacgatggtattgacgtcggtagccgtaaaaaacaccgagcaacattctatgaccaagtcctcctgttcttatcatatgctgaaagaatggatctatccgttgaaaaacgcggaagaagtgacggccgttttgggacgtatgttattgggaaattatgtacagctcgaagatggtgggaatgtaattcccgtaatggtgaaacagaccgatcctgcattcttccgggtgttcccgtttgaattcctgggcggacaggctttctcacaggccgattttgaaagcggaatccacaatgtagtgctctcggagagtggtgcccgccggatattgggtgacacagaagcggtgggacgtacgttctcgctgaattttgaagactatcgggtagtgggcgtggtgcgtagcggcagttatatgctcagcgactcttatgccgacgtgtatatgccctatacttgtataaccggttatgatcggggggataaaatggccaatatggtaggtccttatcaggtgtttatcaaactgcctggggcggatgatgccccgaagctacgtgctgaaatacaggagttggttcataaattcaaccactctcagcccgatctggaaatagacttgaacaatcagcctcttccttattggcagtatcctcttaaacaaatggggtattcggagattgactgggcgaacgtattcaaaatacatggttggctgttgcttgctttcctgtttgttccggccatcaacctgggcgggatgatttccagccggatggaacaacgtctttccgagatggggatacgcaaagccttcggagccaatcgttcggtattgttaggacaggtgctttgggagaatctggcgctcacctgtgtaggcggttttatcggtctgctgttgtcatggggaggtctggtgttggggcgtaattggattttcggtttgttcaattcgtggccggtacccatccccgaaggagtggaggttaatctaagtccggatatgttgttcagtccgtttgtgtttgtccttgcgttcggtacgtgtgtattgctcaacctgctttcggctttttgtcccgcatggtattcactgcgtaaaaacatcatatattccatcaacgaaaagatataaatagccatgaatcaattaatactgaaaaacttgtgggcgcgccgcagtcgcaacctgtggctattggccgagattgtattggtttgtattgtctcttggaaaatagcggaccctttggtcgtgcttacccatgaccgtacgttacctgagggctttcgttccgatcatttgtttgttcttgaattggcgactttgccggagaaatccgggaagtttcgtcccgaagaagacgacagcctgtcccgcagggaaaacctgggccgcatttttcaacaggtgaagaattatgaaggtgtggagtctgctacgttttttttcaatcgtataatgccttattccggtagcagtaccacttctccccagacgtttaagggagattctacctatatgccggcatggcagatctctttcctgaaccgttcggacttcttccggaccatggggtttgaaggagttgaggggatgacggccggagagctggacgaacgtatctttgataaagatgaatatgtgctgacagccaatacgtcggagttctttttgcatccggagagtcctctcaccgggcggacgacatggaacaacgacagcactgccgaatatcgggtggcgggtgtgataaaaccttttcgctatcgaagctatatgcaacctcagccggtccgtctgaatcccctgtcggttatgcccgaacggtattattcggatttgccccagattgttttccgaatcggggatcgtctttccgaagaggtgtttttgcatcacttcatcccttggacggggaaggagttgaaagccggaaatatatatgtgaattcggtgcagtcgtataccgatttgcgtaaacagtcggagttcagtgccggtactaccgatacataccgtaaaaatataactttgggcttgttctttctgatcaatctctgtctgggggtggccggaacgttctggctgcaaacccgtacacggcgggaggaagtcggcattatgctttcattcggagcccggccgcaaaacattgttcggatgctgctgggtgaaggatgggtactgacaacaatcggaacgctgttgggatgccttgtttatttgcaatatgccttgaaagaaggactatactccacaaattggggatcatggtcacccgaagtggcttcgcctgcttattggatcaatcatttcggttggcacttcctggcaacttccctgatggtgtacatcttgttgctgattgtcgtttcagtcggcatttggatacctgcccggaagattagccgcatcaatccggtagatgctttgcgtgatgaataactattaaaattacatactatgataaaactttatttaaaacaatcgtggatgttgatccgtcagaacaagttgttcagcagtctgtatgtactgggtacggggcttgccattgccatgacgatgattattgccattgtgtattatattaaaatagcttctatttatccggaagtgaaccgttcggtgacgatgcggatgaaaggggtgagtgccatgcatgtgaaaggaggcggaaattcatatctctgttcttatgaaatgctgaaagagtggttctacccactgaaatcagcggagctggttaccgctgtaaacgaacactttctgaaccgggagggggcttatatacaaccggccgggggaggtgagcagataccggctttggtaaagtataccgatcctaatttttttcggttatttgagtttgaatttttgaacgggaagcctttttcggaagcggatttagccagtggaatccgtaatgtagtactttctgaccggatggcccgccgcatttttggcaggaccgatgtggttgggcaaacgtttaaactggatttcaaagagtctaaagtcgtcggagtggtacgtgagggcagttatctgttgccggcatcttacgggcaaatctatatgccctattcttgcttgccaggatatgacagtaacaatgatggcagtcataaagtcggtacctatatcgtttattttaaggttcgccagaaagaagatatgccgaaactgtatgcggaggtcaatgaaatggtgcataaatacaatatttcccagaaagaatatacagttgatatttttcatcagccggatccgtattggcagacttggttcagagagggcaatacgaacgagattgattggatgtcggtcattaaactgtatggaggagctcttttggctttgttgttagtgcctgctattaatttgagtgggatgatatccagtcgcatggacgatcgtctggcggaaatggggatacgaaaagcgttcggggctaaccggaaacaattattgaatcaagtgttatgggaaaatctgcttcttacttgcatcggcgggctgatgggacttattgtttcatgggggctgcttgtgttagggcgtaattgggtatttagcctgttcgacaaatatccgacagttgtgtccgacggagtcgatgtggctatcaatccgcaaatgctgttcagtcctttaatgttttgcgtaacatttgctttttgtttgatactgaacctgctctctgcctggtggcccacatggcgctcgttgcacaacgatattattgactcacttaacactaagaaataaatcatgatacgacttataataaagaacctctgggcccgtcgccggaaaaacggatggctgttggccgaattgatattggtatcgatcgtcacgtgggtgattgtcgatccgttggtagtgttgacacacgatcggaatctgccggagggctatcgtcccgatcatcttttcttgcttcagttggcatcgttccctgccgaatcggagcaatttcatgccgaagagaatgatacattggcgcgtaaagccaattttgagcggttgctcgacaagctgaaacattatgaaggagtaaagtatactactttcatcttgaatggccaatatccttcatcgaattccacgagtaacggtaatacgatgttcgataccattccggtccgcactctccgtcttactttcatgccccacaccgattatttccggactatggggatggagggagccgaaggtatgacggccgaacaattggataaccgtgacttccgttggaccgaatcggtattgactgcggacgtagcgtatcggctgaaggatggaaaaccgctttacggacgtcgtttgggggaaaatggagatgatgaagactatcgggtgggaggagtgatcgcccctcttcgttaccggagttatatgcaacccatgcccatagagttatgcgtgtttgaagagtttcctgattatatgtactattatcttccgttaatcgcttttcgtatagacgacaatctgttggagaaggcttttctgcatcacttccgtgagtggatggataaaggactgacggtaggcaactattatgtgaagtctgtacggtccttcagcagcattcaggatcaacatgagttttctgaaggtatcactaaccagtatcgcctgaacctggctttaggtatattctttttagtgaacctttgtttgggagtggccggaactttctggatgcagacccgttcgcgccgtgaagaggtgggcatcatgctttcttttggcggtaatccttcacatatcacccgcctgcttttatacgaaggttgggtgctgaccacattggggacgttgataggctgcttgctctatttgcaatatgcgttgaaggatggtctctatactacctgtaccggttcggaagagacgatgcctgtttattggattaaccatttcggtctgcattttgcggctgtttccctgattgtataccttttgctgttgattgttgtttctatcggaatctggatgccggcacacaaactcagccgcatcaatccggtggatgctttgcgggacgaataaccaataaataaaataaattgctatgatggtattatacttcaaacaggcctggcaactcctgaaacaaaatcctttattcagcagtgtgtacatactcggtacaggactggggattgccatgaccatgagcctggtgatcatctgttacatcaagatggctccggtctatcccgaagagaaccggaaccgtatcctggtcagtaaaggaatgactgttgtagagcagaaaaaccaggagaattggttcagttcgcacgtatcctttcaggcagtgaagcgtttttattatccgctgaagagtaccgaggctgtaggggcatctatggatgggcgcagtacatcattacttgaactgcctggtgacggagatttgaaagaggtacaggtgaagctggtagatgccgggttctggaaggtgtttcaatttgcctttgtagacggcaagccgtttagtcaggccgattttgattccggattacgaaaagctgtcatttcgcgtacaatggctcgccagctttttggagagactccaccggtaggtcgtacttttgttcttgattccgatgaatatagagtatgtggagttgtaaaagatgtttccttcattacccctgctacgtatgcggatgtttggttaccactgacggttgattccgatattataaaggataataagggtggctatgagttggtaggtgatctgaatgtctatatgttggctccttctgtcgatgctaaagataaggtaattacagaggtacgtgacgtgttccgcaaatataattattctcagaaaaaatacagtgtcgatttacatgggcaaccggtatcttactggaaaagtattttttatgaatattctaattcggcacccgactggggagagctgttacgagtgtatggcactatcctgttagctttattatttgttccggcactgaatctggcaggaatgattgcttcacgtatgaagcgccagctttccgaattgggcatacgtaaggctttcggtgcttccaaaacttcgcttctgttgcaggtattttgggaaaatctgtttcttactggcatcggaggtctgttcggtttgttactttcgtatctgattgtctattgtggtcggaactggcttccggacctgttgtctttctcggtagatgtgatgcccgagggagtcaatagcttcttgactcccggtatgttgctgaatccggtggtgataggtattaccttcatggtcagcttggtgctgaatgtattgtcggctctgattccggctttacatgctttgaagaaagatattgtatattcgcttaacgaaaaaagataaaagatatgaacctgatgatgatactccgccagttgtggaaccagcgtgctgccaatggatggattctgggagaactggtggttgtgacttattttttatggggagtagtcgaccctgtgtacgtattattatccgataaggcattgcccgatcattatgatcttaccgatacttacctgctcagtataggtgaatattcaactaaccataccaaatataaaccggagatggcttccgattcgctgaaacgtcttgactttatgcgcatcgtagatcaggtacgccgttatccgggtgtttctaatgtgactgtcagcctttttaattcttatccacaaagcgggggttggaacggaggacaggttttcaatgatacgatccttgcatattcacagcagatgaccttcctttccggaaccgactattttggagttttccgtatacacgatgcacggacagggcaaattcctccggtacttgcggaaggagaacaggggatctacctgactcctgatctcgcagagaagttgttcggcgagaaatatccgcaaaataaatgggtgcattggggagatacgacccgtaagtttccgttgaccgctataatcgcccccgtacagataagaagtaataaccaacccggtcctctgatattcaagactacttctgaattgaaacatcttccgggcagagtgcggatttgtttccgggtgcgtgatggactcgcttcacctgttttcactgagacatttaaacgtgaaatgcgtccccgaatgcagattgggaactattatctggcatcgcttacggatttcaggacggaaagtaaaaattttgagtattatatgggaactacggggactatccggttgcagaccattctcgctttattttttctgttgtgtgtctttttggggatggggggtaccttttggctgcgttgcaatgcccgccgggaggaaatagggctctatatggcaatggggtctaaccgccaccgattgatccggcagtttctttttgaagcctggtggatggtgactatcgcatttgtagtaggagcattggtacaacttcaaatagtatatctgaatggctttgctttcccgccggataatccgaacccggattatatacagaatcgtccggtgttgcacttccttattgtatcggttatttcgtatgttctgattctggctgtttcgtttgtggcaacttatattccggtttcaaaagcagcacggatgaatcctgcggatgctttgcgggacgagtaaccggattggtcggcaaatacctctaccacagaggagatatgaagtaacacagattatttatattgattagcagtgacttaaattttcctctgtgtttctctgtgttctctgtggtgagttttgacacatttacatgatttcaaagaactttggacggtatataacttttttaaatatcagttctgcgaatatctgtattcgttgggcgttactcccgtaattttcttgaaaaacaagcagaataactgcgtgttagaaaatcccagttgaccggctattgctttgattgtattctctttatcaagtagcattctctttgcggtttccattctttttaactggaagaactccggtaaggttttaccggtttcaaacgtgagtaaatcttcaaaataggcaacggagagctttaaattttcagcacaatatgcggaggtaggcggaccttcccactttagcttaccggaataaatataatcatccaataaacggtctgttttgtcgagcagcactttattcttgttttccctggtgataaactgccgttcgtagaaccgggtacaataatccaataatagttcgatgtatcgtgaaatcagtgtttggctatggcggtctatcgggtgatgtaattcctcgtccatttcccgtaggcattctataatcttatccttttcgcgttgggacagatgtaaagcctcctctttccggtagaaaaagaaagtatattcttgaatgtttttttcaagtgtggtaccataaagcagatcgggatggaaagccagtaaccatccctgctgtgggagtactctgtttttgtgcatgtcgaaggtttgttccggagggaggaaaaccattgtcgcattggaatagtcataagctttgcgtccgcaacaacagcagtcctctatgtcgttctccatcaacagtattgtgtaaaaatcgaatttaatgctgtgctgttccacattcgtatggtccagacggataatgcttgcctgtggatgcagcgtcttgcatcccaggcagcggttgcattgatgcaccgttttgatatctaatgtttctttaccggaagaggccatcatacttgaattatcctgtattctgtcggggtacagccaacattctttttaaatatgcgtgtgaaatgttgtgggtattggaatcccagttcatatgcaatctcactgactgttttttctgaagccaatatcttttctttggctacatttattattttaccctggatgtattcctgagcagtcttacccgtttcttttttaaccaggtcgccgaaatagttggaagacaagtttaccttatctgcaaaatatttcactgtgggtaatccttcggtttgcgactgctcactttggaagtagagatccaatagttcttcgaacttcaccagtacgtccttgttcacttttgaacgtgtgacgaactgccgttcatagaaacgcatgcaatagtccaataataattcgatatttcttgaaatcaggcgtttgctgtgcttgtctatcggacgtgataattctaactggactttatccaggcaatcctgaaagatctttttctcttcgtccgaaagatgaagggcttcatttgaagcgtatgaaaagaatgaatactgttcgatttcctgtcccaaagatgtgccgcgtatcaggtcgggatgaaataatataccgtgtgacttcggacgtatcccgtcagtcacctttacctctactacctgtccgggggcaaaacttgttactgtgccttcctgatagtcatacatctgccgtccgtagcgtagatcgccgcactttgtttgtttcagaaacaaagcgtacagtccgtaattgagggtgaagtgtgtggggaacaacgtggctttcgacaagtcgactactgtcaccaaagggtgcaatgtttcgagaccgtacatctggttatactggtctaccgaattgagcttaattacttcttccatagggcatattgttatttatctgtgacaaatgtagggattttcatcatatgtagtatgggttggaggaataaaaccggaataggggtaagaatatccgtaattgaggtaattacatccgtaatccgggtatacgatgagaacggaaaggtgcctaaatttgcatcataaatttataatcttatgaaaatgaaacattttatatgggtatcggcaatgataacgttgctgtgctataccacaaattctttaaatgcacagaatatgaaaaaagaagaagttctacaaaatccgagtgtgtttcccataggagatgcaaacgtgcaatatgcgaagttttttatagggcagtcctatctggcacgcttgacacagaatgatgaattgaattgtcctgtcagcaatgtgactttcgagcccggatgccgtaacaattggcacagccatacgggtggacaaatcctgatagctgtcggaggaagagggtattatcaggaaaaagggaaaaatgcccgtctgttactgcccggagatgtagtggagatagctccggatgtagtgcattggcatggagccgcccctgacagttggttttcgcatctggccatcgaatgtaatcctgaaaccaaccaaaatatttggttggaacctgtagatgatcaggcatacgctgaggcaacttccccccaagggatagctgcaacgagtgtttcccgcaatggcacgacgaggtttatcaatctcggaaacaaccttgcacagaccgatcccgaactggaggaaatattcactaattttgcttttggagaaacacagcaatatggtgatttggatactcgtatgcggattctggttacaatggcttccaccattgccatgagcactgcgggagagtatcaaaaaacactccaggccgcttttgtcaacggagttaccccgcttgaaataaaagaagtgctttatcatgccgttccttatgtgggtatggcaaaggttgcggaattgatttctatagccaatggattcttgtcgtcaaaaggagtgaagttgcctttggagccacaggcggtgataacttccgaaaaccgtatggagaagggacttgctttgcagaaatccatttttggcgaacgaatagacaaaatgtatgaaaccgcaccccaaggacaattgcattttcaggaatatctttccgccaactgtttcggtgattatcaaacgcgtccggttctggatgtaaaaacgcgtgaaatgttaacttttgccatccttgtgtcacttggtggctgtgaggcgcaggtcaaaggccatattcaaggcaatataaatgttggcaatgataaatctgtgttgctgactgtcattactcaattgttgccctacattggttatccgcgtacactcaatgcattggcttgcttaaatgagattgttccggaggataagtaaatcaggcagttcgttaacgggcagtatgttcattatcggacatccttctgttagtttaatgtgcaatttatgaggatgttattcttttggcataccatttgacatgtcttgttcatataagccaaaatggaacaaaacgaatcatctaaataaattaaagttatgattacattaacttctctctcaaaaatctatcgtacaaacgagattgagacagagctctcgagaatgtgaacctgaaagtggatcgcggtgaatttcttagcataatgggaccttccggttgtagcaaatcgactctattaaatattatggggttgctggatgcgcctacaaccggaacaatcgaaataaacggcacacacacggaagggatgaaggataaagaactggctgccttccgtaataaaacgcttggttttgtgttccagtcattccatctgatcaattctcttaatgtattggacaatgtagagcttcccttattatatcgtcgtataggctcttccgaacgtcggaaacaggctcaggaggtgcttgagaaagttggtttgactcaccgtatgcggcatttccccacacagctttccggtggtcagtgccagcgcgtagccattgcccgtgctattatcggtaatccggagattatccttgctgatgagcctaccggtaacctggactccaagatgggggctgaggtaatggagttgcttcaccggttaaataaagaagacggacgtaccattgtgatggtaacccataacgaggaacaggccaaacagacttcacgcactattcggttctttgacggacggcaagtgcaataataggtgtcgaagataattagatcggctttataaaaatctgaactatgattaagcaatacttaaagcaatcgcttgttcttttacagcaaaataggctattgagttctattgccattatcggtacggcattagctatcgctatgatcatgtgtattgtattgatttatcaggtaagaactgccaattacgaaccggagatcaatcgtgaccgaactctatcagttgaaatgtctatagcccagaaaatagaagataaaggatggaatataggtaatatgttgtcactgcgtaccattaaagagtgcttctatccgatgactactgcagaggcagtaagtgccgtacattacagtatgacctctctggcagctactcctgacggaactcaggaagtgaaatgtacagttagttatacggatgatgcattttggcgcgtatttggttttcgctttttgcatggcaagccctatgggcaagagtttgtgtccggtgagaagaagttggtggtgactcgttcgttggctcgccgcttgtttggtacagatgatgtggtggggcgtacagtttcattgggttttgtcgactatactgtctgtggggtagtggcggatgtgtcggtacttgccgaggccgcttatgctgaagcttgggctccctatactgcgttggcggattatgagagaagtgtcagcgatggtttgcagggtggatattcgtgccatattctggcatctcgaggagctgatctggatacagttcgtgccgaagcacaacggaatgtagatcggatgaacgccaatcagaaagaatttaagttgctgctcggcggtgctcccgatacccgtctaatggctttggcccgggataatccgtttgataatccggatacatcacggttggtgattatttacattttggtgattgtcattctgttgttggtacctgccatcaatctgagcggaatcacactttcacgtatgcggcggcgtatggaggagattggagtgcggcgtgctttcggtgctacgcgtggagaacttcttcgacaagtactcgccgagaatcttgtcatcacgttgataggtggtgccttaggattgatcttctcgtacatagctgtgctttgtatgagagactggttgcttaatacttctatgtcgggatattacggagtggacactcaagtgtcggtgggcatggtcattcacccgtttgtttttttgtgtgcattgttgttttgcctgttgatgaatttgttgagtgcgggtattccggcaattcgtgtatctcgtgctaacattgttaatgccattaaatagaagaaatcatgattaaacatttattgaagcagatatgggcgcaacgttcggtcaacacatggttatggattgaattgattttagtttcagtttgtctgttttacgtgatggattacctttatgtaacgggaaggctgtataccattccgcttggttttgatactgagcatgtttacaggataaaacttgcttctatacctcctgatggaaaagaatataaaccaggtgatacggatagtttgaaaatcgaacagtggttttctattctgtcacgtatcagggcctatccgggagtagtggctgtatcattgagtatcggttcgcatccttataatcagaatagttctaatggtggaaaaggaatagatactacttgggtacacggatacacatataaggtatcgcccgactattttcgagtgttctgtgttacggataaacagggggagacagagtcgcttgtcgaggcagctactcaggaaaatacgtggatcgtttctgctgaaaccgaacgtaaatttgccgaaagcggaatagaaatattaggtaaagggattaagaattggggtgagacagaaccgacaaatattatccgtggcatttgcaagaccatgcgttttgacgatttttttccggtttatcctgcgtatatcgagtgctactcggaagcaactttgttaggctggaggggaaataatgttgagttctgtgcccgtgttcgtccagatgtggatggggtggacttttcatcccgtttccgcaaagacttgaaggaacagcttcgtaccggtaatttttatcttttggatataagctctttcaatgatctccgcgagaactattataggagtaacgggaagataaatgatgtgaaaatccggattgccgctttgggcttcttcttactgaatattctgatgggagtgatcggtacgttttggatacgtacgcaacagcgccgttcggagatgggacttaggttggctttgggatctacccgtgcaaatctcagaattctgttgattggtgaaggaattcttttattggtattagccattgttccgtctgcagttattaatgccaatcttgctattatggggatactgaccgatacaatgcctgctactgccatgcgttttctggttgttcaatccattgtgttcgtgttgatagttataatgattgttataggagtttgtttacccgctcatcaagtcatgaagatcgagccggcggaagcattacacgaggaataaacgttcatttttgataagaaagagagttcatttgtgggcagagtgttcattatcggacactctgcccaaatattaagtggttgtttataagtgtattaattctttggcatgtcatttgaacatgatcttaataaaaagaaataatttaaaaccataagtttatgattacattgacttctctctcgaaaatctaccgtacgaacgaaatcgaaacagtggctcttgaaaatgtgaacctaacagtagaccgtggtgagttcctgagcataatgggaccttccggttgtggtaaatcgactttgctgaatattatggggttgctggatgcacctactaccggaaccatagagataaacggtacacacactgaaggcatgaaagataaggaactggcagctttccgtaataagacacttgggttcgtattccagtcgtttcacctgattaattccctgaatgtactggataatgtggagcttccgttactgtatcgccgtatgggctcttccgaacgtcggaaactggctcaggaggtgcttgagaaagtcggtttgactcaccgtatgcggcatttccccactcaactttccggtggtcagtgtcagcgcgttgccattgcccgtgccattatcggcaatccagagattatccttgctgatgaacctaccggaaatctggactccaagatgggggctgaggtaatggagttgcttcaccggttaaataaagaagacggacgtaccattgtgatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaatggagttgcttcaccggttaaataaagaagacggacgtaccattgtgatggtgacccataacgaggagcaggccaaacagacttcacgcaccattcggttctttgacggacggcaagtacaataataatcataatacagtcattcatctcaaaattaggaaacgatgaaaataagagtaatgttagtggctttagctctcacaatgggggcaactttcaatatgatacaggctcaatgcagtgatgattgccaatgtggtaaaactaccggaagtaagggaatcattgttgataaccgtaaagttcccggtttttcttctatccgtctggatgcagtcggagatatcatttttacgcagtccgatcgttgttctgttcggatagagggcccgcagagatatgtatccgaaactacaacgaaagtggaaaaagagactttggtgattggatataaagagaataacagcaattccaaaaatgttaaactgtatattgccgctcctgatctgaagagtgtaaaattgcagggagtaggcagcttcaattgccggaccgcacttcggttggatcaattgaagataactctttcgggagtaggcggtgctgaaattagtgatttggtttgtgaaactctcaaagtacggttggatggtgtaggcagtgtcaatatccgggtggattgtgatgaactgacagctcgtgccgacggtgtaggaagcatgaccctgaaaggtaaagcccgtaaagctgatatttctaaaggtggagtcggaggggttaatacacgcggattgaaagtaggagaataaagagaacacaatgattaaacaatatttcaagcaggccctgtcgcaacttaagcaacaaccattgttgactacgataagtgtgctgggcactgcactgaccatttgcctgattatggtagtggtgatgcaacagcagataaagacggttccttttgctcctgaaagtaaccggaatcgcttgttacacgtcaaacagatgagtgtaggcaacaaaacctggagtgacgacggatcaagtaacggcccaatgggaataaaaacggcgaagggatgtttcgaaggattaaaaactcccgaagaagtcagtatatatagtattcccggaacgatgcaggtttctttgtcgcggggagtgcgtacaggagttgatgcacttgagacagacggagctttctggcgtatattcgacttttcgtttatcgacggcaaaccttattcggatgctgaagctaaatcgggtttgcccgtggctgttataacagaaagtgtggcccgccttctttttggtactgctacaaatgtggccgggaaagagatttttgtgaacgatgccccttaccggttaagcggagtcgtgaaagatgtctcttcaatggcttcgacggcttatgcacaaatatgggtcccatatctttcaactaatatcacaggaggggataatgtatggagtgatggtatcatgggagcgatgcgggttgtgattctggctcgtagttcttctgattttgatgcgattcgggcagagtgtgaacgacatcgtttggcatataatgccggattgggagattattttgttttttaccgggggcagccggatgaccagttgaccatgtcacagcataagtgggcaaatgagcaaccggatatggcgggttattttcgccaacaagtgatcattttccttattttgttgttggttcctgccattaacctgagttcgatgactcacagccgcctgcgacagcgtgtggcggagattggcgtgcgccgttcgttcggtgctacccgcggaggggtgatgggacagattgttgctgagaatttggtgttgactttaatggcgggtgttgtaggattattgttctgtttgctgatttcctatgtgtggggcggtacactttttgccgattcacggctgatgtatctcaatacggctccggtcattgagtggaagatgcttttcaaactctctacgtttatttatgctctgctcttttgtctgctgctaaacttgctcagtagcgggtggccggcttggcgggcatcccggatgtcaatcataaatgctcttagcggaaaactcacttaaacactacatgaacgatgaataagaaattattaaaacaaatagttaatgaacggcgttcgaatgcgtggttgttcgtagagttactgttagtaagtattgtgctttggtatgtggtcgactatatgtttgtcactctttatacttattttgagcctcgtggttttgatatagagaatacttacagggttgaatttaattatctcacggaaaaaagccccgattatatagccggccgtacggaagaggaaaataatgccgatatacgtgagttattagatcgtttgcgtcgtcgtcccggagtagaggcagtcagtatgtcacaaaattcttttccttacaatggcagtaacagtggtatggaagtacgtctggatactatggaaagaaagtataatatccggcggtgggtaacccctgactttttccgtgtattccgttatcggggagctaacggagaaacaccggaacaattgggagctttgctgaaagagggtacttttatggcatcgcgtaatctttttgaatcccgttatcatatagacttaaaagattatattggcaaagaattttgtttggatcaggatacagcccggggtacaaagttgtctgccgcacttgaagtgattcgttacgatgatttttcggccgcttgctatagccggtcggtagtaatattattgcgggaggatcaattagcatatggcaatgaaatctgtctgcgtaccagtgatggtgaacctgccggattcgccgaacggttaatgaaagacgcaccatcccaatacagagtggggaatgtctttttatcgaaagtaaattcattccagaatattcgtcgtactttccagttagacgatatgaatactttacgaaactatttggtggggatgagctttttgctgcttaatattttcctgggattgttgggcactttctggttccggacgcagcagcgtaaaggagagatggctttaatgatggcggtaggcggcagcaagaagagtgtctttttccgtttgctcagtgaaggctggttcatgctgcttctggtcactccgttggcactgggcattgactgttatattgccaaaagcgaactgacaccttcgtggcaattctccacgttcactgtcgggcgttttgtattgtgcgaatgtattactctgctgttgatggcattgatgatattggccggcatttggttcccggcccgtcagtccatgaaaatccagccggcagaagcattgcgtgaggaataaaagcttattgcaataaatcgtaatctatctgcgttgttttcaagattataacgtatatttgcgtccataatcctgatacaacgcagtttttttactatgaacagacgatcgtatactatatttcttatatctatctttttatttctcacagaaatatccactgctgcggaacgcatttataatgttcttttcattcagtcgtatgcttccgaaacaccttggcatggcgatttggccaagggattgaaagaaggattcagcgaatccggactgaaagtgaatgtgacaacagaatttctggatgccaatttctggacttatcagtcagagaaacttattatgcggcgtttctgcgaacgagcccgcgaacggggaacagatttgattgttactgtcagtgacgaggctttccatactttgttgacttgcggggattcattgcctttacagttgcctgttgtcttttttaatataaaatatccggaaggcagtctgatcgattcgttacccaatgtgtgtggatatacggcaaatccggatttcggggagctgttgaggcaggcgaaccgccttttcccgagtcggacggaagtagtctgtatctctgacaacagccttctgagttctaaaggaagagacgactttatgaacgaatggaatggctttgtgaaagagcatccggaatatacggtaactttctataattcgcaaacggatacaaccaacaaaatcatagcttccacatgttatccgcgcaatacgcacaggacactgattattgcccctaaatggtcgccttttatgtcattcatcggacgtaattcaaaagctcctttcttttcgtgtgaaaatcttgcattgactaatggcgccttcggggcttatgatgccgattcatatacttctgcacgtgaggtggggcggacagcttccgatgtgttacgtgggaagactccttcggaagtggggattattgaatctcccttgaattttatgtatgatttcaagcagctggtgtttttcaaggtaaatcccaagcaggtgcaggctattggaggaaccattatcaacgaaccatacggagagaaatatcgtttgctctatatcttactgtatagctcgatattagctttactggtgtttttgatagtgtggctgtatcgcatcaaccgtcgcgaatcccgtcggcgcatccatgcccagacccgtttactgatacaaaaccggttggttgcccaacgtgatgaattcgataatgtattccattcaatccgtgacggtgtgatcacgtacgataccgatctccgtattcattttacgaatcgttctttactgaaaatgctgcatttgcctaaggatgaagccgcgcgtccttatgaaggattaccggcaggcagtatcttcaagatttacaataatggtaaagagattctccgttccatgctcgagcgggtggtaactgaagagggcagtgtggtcattcccgaaaattcgtttatgcaggaagtccacagtggcagctattttcctgtttcgggtgagatcgttcctatccgggcacatggtaaaatcaccggaatggccctttcggcccgtaatatatcggatgaagagatgcaaaaacgtttctttagtatggcggtggacgaaagctccatctatccctggcagtataatatccgtaccggtttatttacttttcctgcgggctttctggtacgcttcgggtttgcagagaacaagaccaccatttcacggaatgagatggaccggatggttcatccggacgatcaggagttggcgttcgaactctttaaccgtgcattggcaggtctgagccagagtacccgtatgagtttccgccagcttagcggtgacggcagatacgaatggtgggaatatcgtacttcggtgcttgcaggacttacgacagacacaccttacagcattctgggcgtatgtcagagtatacagcgctataagactaccgaagagcaattgaccgcagcccgcgataaagcacttcaggcagataagcttaaatcggcattccttgctaatatgagtcacgaaatacgtacaccgctgaatgccatcgtgggcttctccgatttgttgagtgataccagtggatttaccgaagaggaggtaaagttgtttattgagacaatcaataaaaactgtggcctgttactggcacttattaatgatattctcgatttgtcccgtatagagtccggtacgatggatttccagtttgccgggcacaatcttccgttattgatgaagaatgtatacgattcacaacagttgaacatgccttccggagtccggttggtattgaagttgccggagaatagtaaaaaatatctggtgacggataatgtccgcttgcaacaagtggtgaataatctgataaacaatgctgccaagtttacaacacaagggtcgatcacattcggttatacggaggaagagccgggatatacttctatttttgtagaagataccggaaaaggtatttcggaagatgggttgaggcatatcttcgaacgtttctataaagtcgacagttttacccagggagccgggttgggactgagtatttgtcaaaccatcatcggacgtttgaatggagtcatcacggttacttcgaaggaaggaaagggaacccgtttcacagttcgtttaccggatacttgtgaataagtacaccgggggcgtccgtctgcggacaaactgttcattttcggacagaagaaggaggattgattttagacggtgaacggtaaacggtgaaggatgaacaaaaggagtggtggatgacgaacagaagaagaatgaccaggagggaagtggagtgaggattatcatacacagaactctttcaaatgaatgtttatgttatatggcgagctggagtgatcgctgcaacactcaatatttggcacagggtttgcttttctgccggtaaataaacaaattctatatgaaacgatcttttctactctctgcttttgccttctgttcgttggcattgagtgcacaggaaacacgggagattaccttgaatgaagccattgcattggcgcgtacacagtctgtagatgcagccgttgctctcaatgagttgaagacagcttattgggaataccgtacgttccgtgccgatttgttgccggaagtaaatttcagcggaactttgccaagctatggaaaacaatataacagttatcagaatgaagacggctcttactcctttgtccgcagtaataagttagggctgaacggtacgctttccattgatcagaatatctggtttacgggtggtaagatagccctgtcttcttcactcgactttgtgaaacagctggggagtggtggaaaccggcagtttatgtccgtgcctatcgctttacaattgactcaacctatctttggagtgaatgacctgaaatggaatcgccgcattgagccggttcgttatgaagaggcaaaagcagcctttatcactgccacagagactgtaaccatgaacgcgatcacttacttctttaatcttctgctggctaaagaaactctgggaaccgcccgccagaatcagataaatgcagatcgcttgtacgaggtggccggagcgaaacgaaagatggggcaaatttccgaaaatgagcttttgcaattgaaactggctgcattgaaagcccgggctgccgttaccgatgcacagagcaatctgaatgcaaatatgttccggctgcgctctttcctggcaataggagatgatcaggtattggagccggtaataccggaatcagcacccgatcttaaaatggaatacaacaaagtgctgaataaagcattggagcgcaattctttcgctcataacatacgtcgccggcagttggaagctgattacgaagtggctaccgcacgtggcaatcttcgtagtatcgatcttttcgcaaacgtgggatataccggactgaataaggatttctctgcttcttatcaaaaattactcgataaccaggtggtagaggtcggtgtgaagattccgattcttgattggggaaagcgtcgtggaaaagtgcgtgtagccaagagtaaccgggaagttaccttatccaaaatacgtaaagaacaaattgactttgatcaggacatcttcctgcttgtagagaattttaataatcaggcacagcaactttctattgccaatgaagcggataagattgcacagcagcgttataaaaccagtatcgagactttcctgataggtaaaatcaatacactcgacctgaatgatgcccagaattcgaaagatgatgcccggcagaaacatatcaatgaactctactggtactggtattatttttaccagctccgcagtctgacgctgtgggacttccagaataatacaccactggaagccgattttgatgatgttgtgaagaattagtttggttttaaccccaaaaagagtagttttgcaaatcaaaaaaataacacttatgcttttaattatagatgatgatagtggagttcgttcctcgttgagtttcatgctgaaacgtgccggttaccaagtggtaactgtacccggtccgcgtgaggcgatggaagtagtccgttcggaagctccttctctgattttgatggatatgaattttacactttccacttccggagaagagggattgacccttcttaagcaggtcaagatatttcgtcccgatgttcctgtaattctgatgactgcgtggggtagtatccaacttgccgtacagggaatgcaggccggtgcattcgattttatcaccaagccctggaataatgccgcattgctgcaacgcatagagactgctttggagcttactgcaactccgaaggatacacttcaggagcaaagcggttcattgaatcggagccatattattggcaagagccgcggattgacagaagtgttgaatacggtggctcgtattgcacgaaccaatgcttcggtattgatcaccggtgagagcggaaccggtaaagaactgatagccgaggctatccacatcaacagtcagcgtgcccgtcagccttttgtgaaagtcaatcttggaggaatatcccagagtttgtttgaaagtgagatgttcggtcataaaaaaggagccttcacagatgccacttccgatcgtatggggcgttttgagatggcgaataaaggaactatttttctggatgaaatcggcgatctcgatccctcatgccaggtgaaactgttgcgggtattgcaggatcagacttttgaagtactgggtgacagccgtccgcgtaagacggatatacgggttgtttcggctaccaatgccgacttggccaagatggtaagtgaacacactttccgtgaagatctgttctatcgcattaacctgataaccataaaacttcctgcgttgagagagcgcagagaggatataccgttactcgccagacactttgccgatcgtcaggctgagatcaacaacctgccccgtacggagttttcgtcggatgcattgaacttcctgagtcgtttgccttttccgggcaatatccgtgagttgaaaaatctggtggagcgtacgattctggtcagtggtaaggaagtgttggatgcaaccgatttcgagagtcagtaccagcgacatgatgaaagtacgtcaactgcctcttcgtttgcgggaatgacactcgatgaaatcgaaagacagacaattcttcaggcattggagcgttataaagggaacctgagccaggtggctacagcgttaggtatcagccgtgcggcattgtaccgtcgtttggagaaatatgatatcagtgataagtgactcgttgcttatcattactttttaatcgttaatcatcaatcacatgccggtaaaaggatttttcttcatacttatctttctgttattttccatcatgggctttctgttctatgtatccgaaaccattgtggcgaaatatctctatatcgcagaagggttggtgctgttcctcgttttatatctgattttgttttaccggaagatagtgaaaccaatgaatacgattggcagtggtatggaacttttgagagaacaggatttcagcagccgcctaagccacgtaggccaacaggaagccgatcgggtagtgaatgtgttcaaccgtatgatggatcaactgaaaaacgagcgtctccggttgcgtgaacagaatcattttcttgatctgatgattaacgcttcacctatgggtgttgtcattatgacactggatgaagaggtatcccaactaaacccgatggcgatgaagatgatgggagtccgtccggaagaagccgaaggcaggaaactgtccgagattgattcgccgcttgccatagaactggctgccattccgaagggagaaaccagcaccgtgcgactgaatgattcaaatatctataaatgtactcattcttcgtttgtggaccgcggcttccagcatcctttttatttgatggaaggattgacagacgaagtgatgaaagcagagaaaaaggcatacgagaaagtgatccgtatgatcgcgcacgaagtgaataatacaacggcagggattacttctacactggatacagtcgaacaggcattgtcagagtcggatggtatggaagatatttgtgatgtgatgcgtgtctgtacggaacgttgtttttctatgagccgtttcattacccgttttgccgacgtggtgaagattcccgatccccgtcttactccgatcaacctgaatgaccttgcattcagttgcaaacgctttatggaggggatgtgcaatgaccggaatatccggttacaactgatatgtgatgaatcattggacgatgtgaaactggacgcctccctgtttgagcaggtattggtgaatattattaaaaatgcggctgaaagtatcgggaaagacggtcagattaccatccgcacctcatcacctgctgctatcgaagtggtggacaatgggcccggcataacaaaagagactgaagcaaagctcttcagtcccttcttttctaccaaacccaacggacaaggtatcggcctggtctttatccgtgaagttttaagccgtcatggctgtacgttttcattgcgtacatacgctgacggactgacaagattcaggattttatttccgtgattcctgccatctctgggcatattcatccagtatccgtttgattccctggcctattttgacataatccttttcattcaggttggcaagtgacacacgtacgctccattccggtccggcaaaaccgccaccgttcagcaataccaatgaggtttcgttggcgaggcggaaaacaacatccaatgggctgtacgttttcttgaggtagtctacaaactcttctccgtagaatatcttagcccacaccagcatatctatctcactataatatcctacacgcagcggatcgtccaccagtgagaatccggtattatcccacagagctttcaggcgtctccggatgatctcctgcatcttgtttttataccggttctctttatccagtatggcaaaggaagcgaagaggctcatctgcgtctgttgcggcagagacaatccggctgtatgattgagcgccacttggcggctgtcggctaccatgcggtcgatgaattttaatctttcgggggcaagggtcagactggagtaacgcttattgaggattgccttttgttcttccggtaagtgggctatcatccggtcaaaaatattctcttcgtgcagagcgattacggcatcgcgccatccggtagccccgaaatatttggagaaggaatagacgcacaaagtattttgcggcagttcggccatcagcgagcggaaatgcggactgaatgtaccgtatacatcgtctgtgataatcatcaggttcggattgtctttcttcacgatatctacaatccgtgcggcagtctcgggactcagtgtataactgggcgggttactgggattggtaatgaagagtgctttgatctgcgggtttttcaggcggtctatatcttcgtctttgtattgccaggtgtgcagcccgtctgctgtcatctggtccgcagatatttccgtaacgttaaattcatagcgtctcaattgagggatttcaatatagggggtgaagacaggtaccatcaaggcgattccatctcctttattgagcaggaagttttcttgcagagagtcgaaaacgtagcacatggctgccgtaccgccttcggtggcgaacaaatcgtatttgccctttggcggacgactgtcgcacatttcctgtgccagatagtcttgtacaatcatctcggtaaactggaggatgcggtccggtaccggatattggtcacctattaccccttctgcccattcgtggacaagagtgtccgggtcggcggcatgttccagtaacatgtattgataggttccttttaatagttccgcacccggctggctatgattggttttgagaaaagtctcaaagcgggcggcaatcccgtctttttgcgggataccggcaattccttccggcaagtacatcacgtgccgacattcttccagtccgaatttacctaaaaggaagaaagcttcacgtggagtggtggcaatccagttcgggtttccacgtccggcattcagcatggtatgagctatctttttgatgctctcatcagccatttcaatcagtctgtttttcagttcgaaaggactgatactctccatctttttagcaaaacttttagttactgctccgttgttttcattacttttcatcattatgtcagggttatgtttagttaatatcaaaaatctattttacatgagtaacacaattacgactccccagataatcaggagagtatttcccacagcatacgtcactgtatatcctaaagcgggagtctcgctttcaacagcttcctggatggcacctaatgcggcggtagtagtacgtgcacctgctgtgcatcccaatatcagtgccgggtggaatttgaagagatactttcccataagtatgcctactatcagaggaatggaagtagccagtgcgcctacaatgaacaggcttagccccacttctttgaatccctgtacgaaactgggacctgcagcgatgcccacgacagcaataaacatgttcagacctacgttgtccagtatccagagagcaggttcgggaatacgtccgaaagtcggatgtttgctccgtagccagccaaagaacaatcctccgatcaatgcgcctccactggtgctgagactgatggggacaccacccatgtggatactcagggcacctatcagtcctccgatcagaatacccagaccaacgaaaatcatatctgtctggttggttggacggtcggcgtatcccattttcttggcagcttcatccacttcgtgtttggtccctaccaattcgacaatatcacctgcatccacaatggtttgcggcagtaccggtatatcgatacccgcccttttgatacggcgtatgctgacaccgtgcatgaatttctgtgaacgtattgaacttattttttctccggcaaaggttttccgggttaccatgacgggcaatacttcagccggaaagtccaataactgaggatccagtacctcgggaccgatccaatcttcctcgccgataacatattcacggcgaccgctcaataccacctcatcccctttcctgagaatcagggtcggggtgatttcttttacgataactccggcttgtctgacacgttcgacaaacaggtgcttgtcattctcctggaaatagctttcaagatctgatacccgttttccgtcaccaaaccactcattatctactttataagcccggaaagtcaccggacgtgcagcgggcataaagccgggttgatccgcttcgctattccccattttagcctccaattctttacaggcagcttttactttatcgagtccgcccaataacttggggccgagagagcccaatacccatgccgaacctgccgtaccgaagatgtaagttacggcatatgataccgggataatattattataagcctcttttgtttcaggagatatgtttagttcattgatcgtatctcctgccacgcctatgacggccgatatcgtctgtgaaccggccagtaatccggctgcttcccctacattgtaacccataattttagccaatatccaaggaataatcagacagaatacacacatgatggcagcaaatcccatttgggggagtccgtcctttttcagtccccggaaaaactgcggaccgactttatagccgatagcgaataaaaagagtaaaaagaaaacagatttaatggggccgtcgaccgtaatgttcaattgccccacaaggacacctaccagcaatacgcttgtaacgacacccaggctgaactttccgatttttattttgccaatccaaaaccctacgaaaagggtcaaaaagatggcaagctcggggtgaaccctaagttgatgaataatccaatccatagttaatttgtttaggtttaaattctcattaaaaacagcttgtgcaagaaagtgttttgttaaacgggctattcttatatcattgtataaattattaacgttatctttgatgcgttaaattgtatattgttttgaagagtaaatttcgtaatttctttttggcctttggcatcctggccgtcatcatcatgctgttcactttcgatgtgtcttatgatgaactgctggacaacctgcggcgtgccggattttatctgccgctggttctggtcctttggcttttcatctatctgattaataccctttcgtggtatatcatccttcgtagcagtggtccggtgaattcattgtcgttcgcccggctctataaattcacggtttccggttttgcgttgaattatgtcactcccgtgggactgatgggaggggagccttaccggattatggagcttactccctatgtcggagtggagcgtgccacatcttcggtcatcctgtatgtgatgatgcatatcttttcgcatttctgtttctggctcagctcggtgttgatttatgtctttttttatccggtcggttgggggatgggcattgtcttggggttgatcacactcttctgcctcttacttgtcactctttttatcaaaggctaccggaacggtatggctgtggcatgcgtacgtctgggtagtcatatcccttttttgaagaatcgtgcagtctgctttgcggaacttcataaagaaaaactggagactatagacagtcagatagctctgcttcatcaacagcgaaaaagtactttttattcggcattgggtttagagtataccgctcgcatagtggggtgtctcgaagtctggctgattctgaatgtattgactacggatgtcagttttgtcggttgtatcctgatcgtcgctttctcttccctactggccaatctgcttttctttcttcccatgcaattagggggtagggaaggaggttttgccctggcggtagccggcttgtctttgtccggagcatatggggtatttgccgctctgattacgcgggtgcgggagatggtctggattgttatcgggctggcgctgatgaagataggaaatcggagatagagtaatgatgaaagggtggggatgttctgcatctgaacgataaaataaagagggatgatttgataattggtttagaaaatcggatttgcttctcgtagtcattaggatgtaataatagggatattattatcccaagcagaatcgttattgtcacagggcataaaaactaaaaagatagactaaaaaattgttgtaaatttttatgaaatagaagagtagacaatggaacagtatttagaaaaatattcagatgagttatcggctaatggatatgttttatgtaagggtaaacatctgaaaaagctgaatttacaatttgttcccgtcataaatgtcgggagcaaatgtcgcaaggtatctttgctataatgaaaaacttatgcctaaagttacaaatgctttgggaaataacaaagccttgatttgagaaagtcggggggttgtgtcgcaaaaggagatatgctagttttgacagttctttgttacttaggggggctgtattataaaagaactcctttagttgataatatccctgcgaatgataagaatgcagtagaactctctgttatgtccgacatagttattgcatacgaaaaagaacattatccgataaaaaaaacaactgttgcagaattaatagaattttatcttgaagaaaaaggaatgagctaaaagcaacttgccattgagattggaataagtccttcacgggtgaatgattatattgcaggacgttcagagcctacttaaaaaatagcccgtttgctttgtcgggtattgaatattcctcccgctgcaatgttggggggtaaattgagggttatgatacatgcaaatgaaaaggctggatttatgtagcatgttgctctgagaataatatcgtaacaattaacattgttaacgccatttctccgttattttattcttgtgtgcaaataacaagccttttgcatttaaaacacttgctatttgcatttaaagaacaagctttaacgtagtgttaaaataaagctttgggcgagagaaatcttatgctttaaaagcactgtgttttagtttgttaagcacactctttacttctttgtttcaccgaatcccttcttaggtaaaagcctatatacttgcttttttgtcaactacaaatcggggactcatactccctgctatcttcttttcgccttgtttagtgccgctatcagataccttccttttgcccctatgtcactccagcaagtgttggcaatcagccgccacaccgtcgttccctttctgccatagtccgacagcctgagaatggcgtttacttcatttacctcgttaattcccaatctttggagcgtatccgtcagtcccggataattgtgtgtcatcgtattgaaagcgtatcccggtatcgggagagaaacagaatcctccatcctttcttcctccttcccctcggggggagctgaggggggtaattctttattttcctttgctctacttttctttactttactttgtccggaattgcatgcattttttgcgttaacggctacatcgtgtactacatttcccgggctaacggctacatctcctgtgctgacagctacttttccttctttaagcggcttgggtcgttcaatttcctgttgtgtggatgcattgtccgttttttcattgatgtagcgtgcgagtgaagcctgacatgtattgatattttgtatgttcgcatcttctatgtaggattctatcaacgctttgataagttctcctttatgcgaaattattccacgtattggtattcctttctttctgcctcttgttcctttaactgtttctgtattagattgttgtgctttgctaatggtgtttttttacacttttgtctgcaatctgaaataatcctttttctttgtccataatttcttttattttgttaataactaaatgttgttaatttgttgcaaaggtagaaaggaatctatcggtaggcaagtaaagatggaattaaagagaaaatgaacgcttctgattagataactatttgttatatagtatgatattaattgaaaaagtgagtgtttcaatagacgttcgtttaattgaacgcaaagatagggggtatttttagaactacaaaatgtttaataaaaaaaatgatttttctcttttgattgttatcccaatatcttaaaccacaggtatttatgaattaacaaaaaacagtttattatctgtctgattttgttttctgttctcttctgatttatatacaaaaatcatgtgtttttaaacgaacgtctattgaaacactttttgttttcaattccctcgtttaaaggctattataataaataactattttctgcctctccttctgtgatagtggagggtcattaaataacatggatgcactgaatttttcattaaaatccgcattacataacttgaccgggaggtatgcttcgctactccggtgtccccaaagaacatcctgacgtgaacgacatgacaatatccgcatctatcgaatcttcgatggagcgttctcaatctatcctgtcttcttccgctttgaactggtatgccttgcgtatcacttacgggcgtgaattggctttgcaggagtacctcaattcggaggggatagagaatttcatccccatgcactacgaatataccattaaaaacgagcgtcgggtccgtaagcttgttcctgcggtccataatctggtttttgtccgttcctcgcgtagttgtatcgatgccatcaaagaaagcaagggcaccacgcttcctatccgttacattatggaccgtgaataccatcgtcccatcatcgttcctgattctcaaatgcgtaatttcatggcggtctctgcgaattatgatgaatccctgctttatttcgaaccttctgagttgaacatccgcaagggtacccgtgtgcgtatcaccggggggcttttcgagggggtggagggcgagtttgtccgtgtccgcaatgaccgtcgtgtcgtagtcaccattgaaggagtcatggctgtcgccaccacttttgtccatccttcattggtcgaacctgtcatcgaaaaataacataaaaagatatgaactatttagaatccgaaatctccgccctttatgcttctgcccatgaactttgctacttaggcatggacggtcggccgatctacagtgatcaattcacccgtctgaatcgtgatgttttttctcaggctaatgctttgtacgacaagcatggtgatagtgatgaagaagaggcccggttgtgcctgtcgctcctgatgggatataatgcgactctctataataacggtgacaaggaggagcgtatccaacatattctggatcgttgctgggatgtactggaacatctgcctgcctctctgttgaaagtccaactgctggtttattgttacggagaggttttcgatgaggaattggcccgggaagctcaggtcatcatcggtacgtggcaagacagggagttgtcggaagaggagcgtgaggtgatggaacgtctgaaggatgtgcaagagaatccgtatccttggagtgaggtggaatgatatgtctgttgtcgaatctcgtactgccaaaagtgtcaaaaatgctaaggtagccctatttttctatttcataaatttagttcttcagttcttttctcgcaaaatatttctggagtatcttggagccgaagtattaggactaaacactactgtccaaaacctgcttggctttttgaatcttgcggaactgggtattggtggtgctgttgcttacaatctttataagccactttttgaaaagaataagcaggctatcaatgagattgtttcggtacagggttggctttatcggcaagtagcttatgtcgtcattattggggcttgcattctgatgtgcttttttccgttgatatttgccaaagcacaggttcctttgtggtatacctacggctcttttattgttttgttggttggtgctttgcttagctattttgtcaactatcgtcaaatagtgttgacagcagaccagaaggaatacaaaattactctgaatgttcagggtttcaagatactgaaagttgtccttcaaatacttgccatttgctccttagacaatggatatgtttactggatggttctagagctgcttttttcggttactgctgccattgtgttagataaagtcttgaagcgggaatatccgtggcttaactcttctcctgtgcaagggaaagagttaagagctaaatatcctgagattattaccaaaacccaacaaatgtttttccataaaattgctggtttcgttttgacacaaaccagccccctgatcatctatgcatacgcttctttgactttagttgctgtttatggtaactatatgttaatggttaccggagtaacattgttgatgaatgctttactaaatagtgttagtgcagggattggtaatctagttgcagaaggcgataaagaacggattaaatcagtcttttgggaactaacttctttacgagtttggttagcatctattatttgtttcggtatttataaattaggacactcttttatagccctttgggtaggtcaagagtatgttctaaatcagtctgcttttattattttgatagttattgcctttattggcttgacacgaacgaatgatgcttttctggctgcttatggtctgtttcaagatgtttgggcacccatcacagaggctgtgttaaatttgggattatccatcttgttaggttacttttggggattgactggtattcttgttggagtcacaattagtcttttgcttattgtatacgggtggaaaccttattttctttatcgctgtgggtttaaagagaaagtttgggagtatattttacgttatacaaaatactttcttttgctggcagcttcctttatcatagtttcttttttggttgatagattcttggcagaagtagttgtttcttattggcaatgggctgtttatgcgggtaagatacttgtactgtacataataatcagcgctttattatttgcctatgcggatagtggtgcgcgtgcctatcttaaaagattttattttcttttacaaaaagatgataaaaccgattgatagggttaaaaatgcgctaatttaattttgccaacgggtatatatgttggggggatcatttagaatatatttgaaagtacattaataatgcagttcgtttttaatggtcaatactaatgtgcttatatttttgagatattatgaaaaaacaagagtctttttcataaaccagaattgcttgaaatagatatagaattgtagaaagcaaaattgttaagataagtgttctctaaaaagtattttatgttattatctataattattcctatttataatatagagaaatatattgagaaatgtgtttctagttgtttacagtcatctcaggtctcatatgagattattcttgtaaatgatggaacaaaggatggtagtatggatgttattcgtcatatgtccaatttacctaatatttctattattaatcaagaaaatcaaggcttgagtgttgcaagaaatacaggcttatctaaagcaaaggggaaatatgtatggtttgtagatggtgatgattggatcgaaccaaattcaatccaacttttggcagcaaaattgaataatgatactcccgacgtgttagcttttgatgtcaatatacataagactagtttgaaaatgaagacagtgtccggtgtggtagcgggtgaggcttataggggatttgactttatgaggttaactcctatttatagtgtttggcgtttttggtataatcgtgattttttattgcaaaatgatattttatttaagcctggtatcttccatgaagatggggattttaataccagagtattggctcatgcaataaagattatatattatcctattttaggttatcattatatagcagatagagagggatctataatgaatatggtatccttaaaaaggatatgtacaggatttgattttatagaaatatttaatcaatttattttagataatcagttttcaaagaaagatcgtgccctaatagctatagatcgttggagggcattagatagatatttctttcatttatatgatcgattatctgcaaatgacagatccctttttaaaaaaataatgtataagaaaagaaaaagtatatgtcattgtttgtatttaactaataagataagatatattttatgcataccttttatgtattatttccctagtatctatatgtatattcgaatatttataaaaaataatctcaaaatttaatgattactttttaaaagttgtcttttatttagaaatatctttctccaagtatatactagtattaatcatagacttatttatgaataaagttatattattaaattacgcagatcagaaattttccattcaacaaaaatataattatatatcagcaaaattttttggaggatttgatgagtatcatttgacctctgataaagatatagatgaacaatttaaacaattgaattgtgaaatattcaatattgaacgcggaggaggattgtggctttggaaaccttatgttattttaaaaacattgaaaacgattgatgatgatgatgtcttagtatattgtgattctggaactgtttttatacgaaatatatcgtatttaatagattttatgaatagaaaaaaaatggatatattgttatttgatactcctctacttgaaatgcaatttactaagaagaatgttttgaactactttaactctgatgggctgaaaaatcagatttgggctggttatatgcttatgagaaaatctgaatttacattgcgtttttttaatgaatggctaagtttatgtcaaaatatagattttctttatgatgatggaaaagtgaagcaacatgattattttttagcacatcgtgaagatcagtcattactttctcttttggcacatagttacaatttaccatcttttagagagccaacgcaatatggtgaacatccatgggagtatatgcgacctggaagattttattgtccactatctcacgctgaatccgattaccctcaaattttaattagttcaaggagatggcatccagtttcattatgtgttattgaatttataaaattacttttgtataaaagtagaatttatacaaaggaaatttatgtaaataagcatggatatagacagatgcaattgtttgataaggagtttattaatttttaggtgtgttaaaaacgtttgtctattgtggcttttaaatgtatagtgagctatttactctttagctatctctttttgggaatatttacgaatgcgtttgctatatcttcatttgttacaatttcaacatttatagcatttatttttgttctgatttatattttcttgctttgcttttctcaagtaaaaattaaaaagagagataattattttctacttttattttggactgttttaacgttttcatcaattctattttcaaggggggagaaatgtcttaatcattatttgatgtggtctttttctttctttgctttttattatgtttttagagttttgttactctatttgttggcatctgaaggaaaaaggattcttgctacaacatttaaaatcttatctttgtctgtttttatttcatccttgtttgctattatagaatttgttttggtcaatttcggaggattaactttggattatattattccaagagggactgttgaagattatgctccattggctttcaattttatacgtgcaagatcgtttatggaggaatctggacagtttgctttattcttagagatttttgctcccataactattgtttggatttttactaatactaaatgcaaagtgattagatatttgtatcttttcgttataataatatctttgcttttgtcatttagttcatttggtttgatagcattattaatgtctgtattaatatatctgtattattatattttttcgtctgtaagtctaaatgtcttgttgaagaaactgttcttgacttgtattatttgcttgtttatagtattaatttttttccctattttagatatgggttatcaggttgtaatgactaaattagatactgataactcttctttcaatgatagaagtgataggattataggattggaacattttctttcaggggttaatctaatagttggttatggagctgctgcttttagtactttgaagactccatcttttatttctttgtatgttggcatattaatgagtacaggtattttaggtatagtgttgtttctttcatttttgttgaattcatttaggcgtatattaagaattaaagataagagagtgcgttggggctttgtggctgcatttgtaacttcaactattcatttctgttttgttgacttgatttacgttccttggtattggacaatgttggccttatcatatgcttgtagtgtaaaagaaaatcttttattaaatgattaaaataagtataattacggtttgctttaatagtgagtcttatattgagcaaactataaaaagcgtcttgtctcaatcttataatgatattgagtatattataatagatggtggttctactgatggcacaattgaaattatacgtaaatatcaagaaagaattgctgtgtttgtgagtgagcctgatgaaaacatgtacgatgccattaataaaggtatgaagtttgcgactggagattatattgctgtattaaattcagatgacatctatttaagttcagatgtaattagtaatgttgtaagcaaattgaaaagaatgccccagaagtataaagctatctatggaaatctgaaaaagattactgctaatgggcaatttattaaaaccaagagaggatttcaggtcaactttcgtactttgctgtgttctaaaaaattgacgtttgttgggcatggtactctttttatttctaaaaatgcatgtattgatattggtgaatatgagtatagtaaattcaaggctgcagcagattatgattatatcttaagactattcagaaaatttagatgtcaatatgttaatattgatatcatgggtttcagagtacatgaaataagtatcacatcatctggaaagatagatgaagagagaaaatccgtgttaagtaagaatggttatgacgagattttatgtatagaaaaattgatcagatattacttttcttggggatatttcgccatgattaatataaagagcatggggattgacaatctaaaatcttttttgttgtataaataaggttatcactgtataatttgagctgtttaagatttataaagaagtagtaattacttgtaatttaatatttaaagatgaatgtattgcacataataaattctttggaaataggaggtgcacaaaaattacttactgatatattgccattaatgaaaaatagtggagtgaatgtatctttgctcgttttaaagagtgttgataatagttttgatgcaaaaataagaaatagtggaattcaaatttattctttaaattgtaaaagttattacaatccattgctgattttacgtttgtttcctttacggatgaaataccaaattattcatgtccacttattccctgcattatattgggtagcattaactaatttgctatttccatcagctatgttattctttacggaacatagcacaaacaatagacggagaggaaaaaaaatattatttttaatagaacgatttatatatggacaatataaaagaattatttccattagtccccaaacgcaatcgaacttaaaagaatggttgaatgctaaagataatgattcgaggtttgttcagataagcaacggtgtaaatttgagtgatttctttataaataacgaaaagaaatatgcgaaaatatttgatgtgtcacgaaaaactaaaattgttttgatgatctcaagattttctattcagaaagatcacgagaccgtcatcagagctattccacatatagttgctgataatgtaatatttgtatttgcaggtacaggtcctacaattgaacactgccaacgattggctcgcgaattaggagtcttaaataaaatcatttttttaggtcaaagagatgatattccagaattaatctctgcttcttatataggagtacaatcctctttttgggaagggtttggattgacagctgtagagtttatggctggtaagaaacctgtaatagcttctaatgtagcaggacttaagcaagtagtggaaggggcaggtttgctatttcccgcaggtaatgagaagtatcttgcttattgtattaccaaattactgatcgacaaacaatattataatcagatttccgaaagatgtttcaacagagctttccaatatgatatacatatgatggttgaaaaatatatagaagaatataagaaagttttaagtaaaaaaataaatgcagggtcttttcatcgtagttaacgttgattggttttttctctctcatcgcaaagatattgcactaactgctcaaaagtctggttacaatgtcactatcgtaaccaaggataccggaaaaaagaaagatattgaggcacttggcctgaaggtgatcgatttaccgatgaatcgttcgggacaaaacctgttagaggaactgcatacttgttggttcctttaccatctttatcgttgtgagaatccggatattgtgcatcatgtcggtttgaaaacgattctttggggcactttggctgcgaaattagctaatgtccacgggatcgttaatgccgttagcggtttaggtatattcttttcagagggaaaccggtctattatttcgaaattacttcctaaagtacttcgtttttctcatcaccgtaataatgtcgctgtcatttttcaaaatgatgaagacaagtcattgtttttaaaacatcagatcataaaggaatctcaagcttataaaattaagggatccggggttgacttgaaccagtataattatactcctgaaccggaggaggggaagatcaaagttctgttaacagctcgtatgattgtagagaaaggtatctttatcttgatagattctgctataaaacttagggagcaataccagggtaaggttcagttcttattgtgtggcggacttgatgacaatcccatggcaatacaagaaagtgaattacaagaggcatgtgacgggaagtatatcaagtggttaggttatcggacggatgttttggatttgttaaagggctgccatattgtcgctttcccttcttactataaggagggactgcctaaatccttgattgaggcaaccgctataggacggcctattataactactaattcgataggatgtaaagagactgtaattgatggctataatggatatctgattcccataaaagacagtgatacgttggcttcccgattaagttttttatttgaaaataaagatgtaagacagagtatgggacgtaattcccggaagctggctgagaaggacttttctattgatgacgtaataaagaaacatttggatatttatagaacattagctattggaactttatgaaattattggtaaccggtgctgccggatttataggttcgcatgtttgtaagcgtcttttgcaacgtggggatgaagttgtgggcttggataatatcaattcgtattatgatattaatttaaagtatggacgcctttcgagcttaggtgtttctcaatctgaactgtcatggtataagttcacacggagtaatgtttatcctcgatttagttttgtgcggatgaacctcgaggataggcaggctatgcaaatgctgtttgctaatgggaattttgatgtagtaatcaatttggccgcacaagcgggagtgcgctactccattgagaatccatatgcttatgttgaaagcaatatagacggttttctgaatgttctcgagggttgtcgtcacagtcaggtgaaacatttggtttatgccagttccagtagtgtatatggcttgaatggacaggttcctttttcagagaaagatggcatcgcccatccggtgagtctgtatgccgcaaccaagaagtccaatgaacttatggcacatacttatagccatttatataatataccttctacaggtcttcgtttcttcacggtatatggtccttggggtagaccggatatgtctccttttctatttgcggatgctatcttgcatggtcgccccatcaaggtctttaacaatggcaacatgcttcgtgattttacatatatagatgacattgtggaaggtgtcttgagagtggctgattctattccggaagggaatcagtgctgggatgctgaggttgcggatccaagcatgtcctgtgctccctataagatttataatattggtaattcccgtcctgtaaaattgatggattttatacgtgctatagaaatgtcaatcgggagggaagctgacaagatctatcttccgatgcagcccggagatgtgtatcagacctatgcggatacttcttctctttcgcgggaaattggttttcaacccaatacgtccttggagacgggcgttaaggaaacaataagttggtataaagaattttataatctataattatgaagattgctatagttggtacaggttacgtcggtttggttacaggtacctgtttctctgagatgggagtagacgtcacatgcgttgatgtgatggaatctaaaattgataatcttaaaaaaggcataattccgatctatgagccgggacttgaagacatggtgcaccgtaattacaatgcggggcgtttgaagttcactacttccttagcctcatgtttggatgatgttgaggttgtgtttagtgcagttggtactcctcctgatgaagatggcagtgcggatttaaagtatgtgcttgaagttgcccgtacgattggcaaaacgatgaaccattatgtactggtggtaacgaagagcactgttcctgtcggtacagcgcaacaggtgaaagctacgatccggggtgaattggataaacgcggtttgaatcttgaatttgacgtggcctccaatcctgaatttctgaaagagggagatgccgttgatgacttcatgaagccggatcgggtagttgtgggagtcgattctgagagagccaaatctatcatggagcgtttgtataaaccgttcatgatgaataattatcgtttgatctttactgatatcccttctgccgagatgataaaatatgcggcaaactctatgttggccactcgtattagttttatgaacgatatcgctaatctttgtgaactggttggtgcaaatgtaaatatggtccgtaaggggatcggtgctgattcccgaataggtagtaaatttctatatccaggttgtggatatggtggttcttgttttcctaaggatgtaaaagccctgataaaaacggctgataagaatgggtattccatgcgtgtgcttaaggctgttgaagaagttaataattctcagaagagtattctttttaataagttgatcagatattttgatggaaatctttcgggaaagcgtattgcgttgtgggggctgtcttttaaaccggaaacggatgacatgcgcgaggctcctgctctggttctaatagataagatattgtcttgtggcggtcttgttaaagcttatgatcctattgctgttgaagaatgtaaacggcggataggtgatagcatagagtatgccaatgatatgtatgatgcggttcttgatgcggatgccttgttactggttacagagtggaaagagtttcgtatgcctagctggggtgtattgaaaaagacgatgaatcgtgctttgattatcgatggcaggaatatttatgataagaaagaactgcatgatatgggtttggaatatacgtgtattggacagtaatgatgaatatattagtaacagggattcatggctttgtgggttctaacttggttgaagctttaaaagagaattgtgtcttttatggtttggatattgtggctcctgttaaagatggggtattgaaaactttttcttggcaagatattaaatctacttctttttctacccaaactcttcctaagtttgatgtcattattcatcttgccggaaaggcccatgatacgaaaaaccaatcggttgctcagtcctattttgatatcaataccggtcttacccaaaagatctttgatttctttctggaatcatctgccaagaaattcattttctttagttcggtgaaagctgctgctgatagtgtagtaggggatgtacttactgaagacgtgattccgactccggtaggaccctatggcgaaagcaagatacaggcagaggagtatataaagaagcattttacattctcaaacacggataagcaggtgtatattcttcgtccctgtatgattcatggtccgggtaataaaggaaacttgaatctattgtataatgtggtgaagaaaggaattccctggccattgggtgattttgaaaatcgtcgttcatttacttcaatcgataatctatgttatgtgattgagggattattggcaaaagatgtcccttcgggtatttatcacatgggtgatgatgaagctctgtcaacgaatgaattgattgccatcatgtgcgaggcaatgggaaaacagcctcacatctggaaaatgaacaagcgttttatggaaggatgtgccggactggggactttactccacttgcctttgaataccgaaagacttcgtaaactgacggagaattatgtagtaagtaacgccaagataaaggtcgctttggggattgataaaatgccggtcaccgctaaagaagggctgatgaagactattcgttcatttgaagaaactaaataacttatgtactatctgataatcttagttctgctattcttagcagaacttttttattttcatattgccgataaatataatattatcgacaagccgaacgagcggagttcgcatacccggatcacgctacggggtggaggaattatcttctacttgggtgcattggcttattttctgacaagtcagtttgagtacccttggtttatgttggctctcactctggttacggtgatcagctttgtagatgatatccgctccatatcacaaggacttcgtcttgtttttcattttacggcgatgggcttgatgttctatcagtgggagttgtttacttttccctggtggactgtagttgtggctttgatcgcatgtacagggattatcaatgcctataattttatggatggaattaatggaatcacggggggatattcgctggttgtacttggagctttggcatatgtgaatgcagaagtgatctccttcgcagaacagaattttatttatacgatgatttgttctgtgttggtgtttgacttctttaatttccgtaagagagcgaaatgctttgccggtgatgtaggttcggtcagtatagcttttgtagtcttgttcctgattgggagtttgattcttcaaacgaaagatttcagctggcttgtatttcttgttgtgtacggagtggatagtgtgttgacgatcgtacaccggttgttgctacatgaaaatattggtttgccccaccggaaacatttgtatcagataatggctaatgaattgaagataccacacgtggtagtgtcattgacctatatggtggtgcagggcgtagttgtggcagggtatttggcattgcgggagtatagatatgggtatttatcagggagcatattggtgttgggcctgttgtacctcctgtttatgaagagatttttttatttgcataaatctaattaatcatgaacttaacagaaaatgattttcagcgtgtggcagattggcttggcgttgaagtggcagtggtaaaagccacacaggtagttgagaccggtggtcgtgggggctttgtggctccgggacgaccggtgatcttattcgaaggtcacatcttttggcgtgaactcaagaagcggggacttaatccggagaggcatgttgcgggcaatgaaaatattctttatcctaaatgggagaaggggcattattatggcgggataagagagtatgaacgtctggaaaaggcccgggaaatacataaagaagctgctgacgcttccacttcatggggaatgtttcaagtgatgggctttaactatgcgatgtgcgggtatggcagtgtggaggaaatggtgaaagatatgtgtgtcggagaagataagcaactggaagcttttgcgaggtttgtgaaatttgctaagctacagtcctgcctggagcagaaagactgggccgggtttgccaggaggtataatggacccggatatgcccaaaatcagtacgataaaaaactggaagaggcttatcggaagtttacgaaggaatagaaatgtaatggataggagaaagcaggttctaatgaaaatatcaggaaagtcatagatgtaatcagatagaatgagtgaaaatataccccaacgggtataaattcctgctttgttcccacttttataccatatcgggtataaaagtgggagtcttttattatatttgtacccaaacgggtataatatgggaaatcaaacaatagcagagtatgtgaagcggatgcgtagggaaacagggcttacgcaagtggatttatcagagaaggcaggtgtcgggttgcgttttgtacgggagctggagcagggaaaagaatctctccggctggataaagtaaatcaggtacttagcttatttggtagtcaggtaggagtagtgtcaattagaaaagaagagttatgaaaaaggctgaaatttatgttagcaatcagttagccggtattttgattgaagatgaaaatggcttttctttcacttatacagacgaatatatttcaaaggggaaccgacgacctgttagtctgacgcttccgattacccctgtctcttatacaagctctgtgctgtttcctttttttgatggattaattcctgaaggatggttgcttgatattgcggaacaaagttggaagataagtagtcgggatagaatggctttgctgctggcttgttgtaaggattgcataggagatagtactcttctcttggattacggggaattctgatatgcatttgaagaacttttctttatatagtacgaaacctattagttatgttctgacacccgcttatgacttactgtcaacgaagttagtccttcctgccgattctgaggaattggcattaactcttaatgggaagaagaagaaaataaagaagtcggactttgttgttgcaatgaactcgaccggcttggaagataagattattgaaaatgtttttaataagtttgatcaccttcagtctaaatgggaagagtttatagatgtttcttttatacaagaaacaaccaaagaaaggtataaggagcttatacatgaaaattggaaaaggattaagtgatagctcaataaaaagaaaggcgacttgattgcaagccgcctttctttttatttaatctcaaattcttccttcatatcgatctcttctccatgtgaatcgtagaatacgtattcaagaaaagcgagtttctgactcggaataattttaataccaaatccgtatttcatctgccatttgcgtttcagcgacataagtccctgattcaaataggcagccacatacgggtggatgtgtagtgagaatttcttaatcttcagtttattgaccagataatcaattttactctccagtgtgtccgtaaagaggatggacgatttgatggtgcctttgccaaagcaagttggacaagtttccatcgtgtttacatccatggccgggcgaacccgttgacgcgtgatctgcatcagtccgaatttgcttaagggcagaatgttgtgacgcgccctgtctttttgcatgttggcacacatacgttcgtaaagcttctgacggttttcggcttcattcatgtcaatgaaatctaccacaatgataccacccatatcccttagcctcagttggcgtgccagttcgtcggcagcccccaggtttacttcgagtgcgttaccttcctgcccgttggcattcttggtgcggtttccgctgttcacgtctactacatgaagcgcctcagtgtgctcaataatcaagtaggcaccactcttgtaggatactgttttaccaaaagacgatttaatctgtttggtgataccgaaattgtcataaatgggaagttgacctttatacaacttgacgatgcctgcccgttcgggagcaatcagcgtcacataatccttgatttcgttgaacaccgcttcgttgttcacgtggatgttctcgaaagaaggattgaagagatcacgcagcaaagctacggcacggcttgtttcctcgtagataagtgtcggaaactttgtggccttttgtactttggtgatactttcttcccagtgcttcagcaatactttaagctctccatcgagttcggcaacacgtttgccttctgccactgtgcgtacaatcactccgaagtttttcggcttgatgctcatcagcagttgtttcaggcgtgcacgttcttcgctcgatttaattttttgagagacagagaccttgtcgttgaaaggaatcagcaccagatatcttcctgcaaacgagatttcggaagtcaggcgcggtcccttggttgagataggctcttttacaatttgcaccactacttcttgtcctacctttaatgtattggctactgtgccatccttgtccaggtcgggaagcagggttgctttcgaaatgggattaagcttttttttgtcgcttaaagtctgctttacgtacttttcgagtgagttaaattgaggacccaggtctaaataatgaaggaaagcatctttctcgtaaccgacatccacgaagcaagcattcagtccgggcatcaatttcttgacgcggcccaaatacatattgcccaccgaaaaggagatatttcttccttcgctttgaagttccaccaaactcttgtcctcaagtaaggcgatggagacttctttgggctgtacgtctactactaattcgcttgtcacgtctgtttcctaattatttaattttataaaaaaatgaacgaataactttatgcgtttgttcattcagtcgggcatttaaacaaagaacaaactcgaaagacatttgcttcacaagtttgttctttatttctgtccagattcagactaaaaattactttttgcttttatgtctgttctttcttagtctttttttacgcttgtgcgtagacattttatgtctttttttcttctttccgcttggcatagcttcaaaattttatgggttaatactcttgtttattatttctttaccgaaagggtgaatgtcttagctggtttgaacgccggaatgttgtgttccggaatgatgatagtcgtattcttagaaatattacgagcggttttttgagctcttttctttacgacgaagctaccaaatccacggaggtaaacattctcgtccttagacaaagaatctttcactgcatccataaatgcctcaactgttgtaagtactgttactttgtcaacaccagtgttctttgcaatttcgtttacaatatctgctttagtcatttttccttaaaaaaaatattattactatgttctttctaattttttggactgcaaatatatagctttttagtctcccaaaaaaatatatcccgaacaattttctaaaaaagtcgcttcattaagctttcttagttcgtaattagatgaaaagaactacttttgtgcaaggataaagttaacaaaaagtagaatctggctaaatatatgaatcctaacttcagcaatacaatagaaaagtggtatcaggaatataaaagggaacttccatggagggagtccgcggatccttatgtgatatggatttcggagatcattctgcaacagacccgtgtcgtgcaggggtatgactacttcatgcggtttatgaaacggtttccggatgttgccacattggcccaagcggatgaagacgaagtgatgaagtattggcaggggctgggctattactcccgtgcacgcaatttgcatgcagccgctaaaagtatgaacggggtgtttcctaaaacctatccggaagtgagggctttgaagggggtaggtgactatactgccgctgccatctgttcttttgcctataacatgccttatgcggtagtcgatgggaatgtgtaccgggtactttcccgctatctgggcatcgatactccgatagattctactgaagggaaaaagctttttgctgccgtagccgatgaactgctggataaaaagaatcctgctctttacaatcaggctatcatggattttggagctatccaatgttcgcctcagtctcctaactgcatgttttgtccgttggcaagcggctgctcggcattagccgggggaatggtggcacaacttccggtaaaacagcacaaaacgaaaacgaccaatcgctacttcaattatatatatgtacgtatgggtgcgtatactttgattaataaaagaacgggcaatgacatctggaaaaatctgtttgagtttcctctgattgaaactcccgaagctgtctcggaagaggaatttccggcgttgcctgaactcagagccatgtttgcggagggagagacccctataatcggtttggtttgcagggatgtgaaacatgtactttcacaccgggtgatttatgccaatttctatatggttgatcttccggagaacagtcagtcttttacttcttatcagaaaataaaagccgatgaattggagcagtatgcggtgtcgaggctggtacatgcctttatcgagaaatacattaactaattgaaaattatcactgtgttaaactaattagatatctaaaattatgagacgatcctatttattattggcctgtctttctccggtagcctgtataatggctgcaaacggacaaaaaggaggtaagagcaaacaaaaggtaaacgaacggcaattgcccaatgttgtgtttatttatgccgacgatttgggctatggcgaccttgaatgctatggtgccaaaaatgtacagacccccaatgtgaaccgcttggcttccgaaggtatccgcttcaccaatgcacatgctacagccgctaccagtactccctcacgttactctatgcttacaggcgaatatgcttggcgtcgtcccggtactgatgttgccgcgggaaatgccggaatgattattcgtccggaagattataccatggcggatatgtttaagaatgccggatatgctaccgctgccattggaaaatggcatctgggattgggagacaaagccggcgaacaggattggaatgcccctcttccggctgcattgggcgatctgggatttgattattcttatatcatggctgctactgccgaccgtgtaccttgtgtctttatcgagaacggaaaggttgcgaattacgatccgagtgcccctatcgaggttagttaccggaaacctttcgaaggtgaacctttgggaaaagatcatcccgaattgttgtataaccagaagcacagtcatggtcacgatatggctatcgtcaatggtattggccgtattggctatatgaaagggggaggtaaagctctgtggaaagatgaaaacatagctgactccatcaccagccatgctatcgattttattcgtgatcataaagatgagcctttctttatgtattttgctaccaatgatgtacatgttccccgtttccctcacgaacgtttccgtggtaagaatcctatgggactccggggggacgccattgttcagtttgactggagtgtcggacaaatcctggaaacacttgacaaactcggtctttctgagaatacgttgattattctttccagtgacaatggtcctgttgtggacgatgggtatcaggatcgtgccgaagagctgctaaacggtcatagtcctgccggcccgcttcgtggtaataaatatagcgctttcgaaggaggaacccggataccggcaattgttcgctggcctaaacaaatcggacagccgcaggtgtcggatgtattggtttcacaaatcgactggttggcttctctggcttctctcgtaaatgcgcgtctgcctaaaggggctgctccagatagcttcaaccgcttgggcaactggatcggaacagattctactgaccgtccctgggtgattgaacaggcttctaaccatacgttgtcggtacgtaccaaggactggaaatacattgaacccaacgacggaccgaaaatgattacgtggggaccgaaaatcgaaaccggcaattcgagtatccctcaattgtatgatatgactaaagcctatgaacaagaaaaccttgcagagaagaacccggcaaagctctttgaactgcaaacgattttaaggaaagtgcgcaataaaacttatagagctttataaaagttgtaacaattcttgcattctattgttattctacttaattttggcaacaaaaatcggtatttagaaacataaaactctgagaatatgtcagtaaataaagtgatattgataggaaatgtcggtaaagaccctgaagtgagatatttggatacgggtattgctgtggccagttttcctttggctacaaccgaccgtgcatatactttgtctaatggtacacaagtgcctgagcggactgaatggcacaatcttgtactttggcgaggactggcagaaactgccgagaaatatgtacataaaggtgataaactctatgtggaaggtaagataagaactcgttcttatgatgaccagagtggggcaaaacgctatgttaccgagatatttgtagataatatggaaatgctgactccgaaaggtgccggtgccggatcgtatgctccgtcacagcagcaggctgctgctcccgtacggcctcaaccgcaacaaccgcagcaatcggcatcttcacaagataatccggcagacgatctgccgttttaatggttgcggactacaagttaaggatgatagttgtcatccggctgttaccttaacttgtagttcataactcttgactaacaacttgtagccagagtttaactcgcggctgcttattattaacttaaaaccaatattttggacccagacgcttatttatgccagttggcagaaatttttaacggaatatccgtacacacaccatcattatcagcaataatagccatcgtactggccggtttgctcctgctcgcttcgggctttgcttcggcatccgaaattgctttcttctcactctcaccttctgatctgaatgatatagaggagggtaatcacccttctgatggaaagatcagcaatctgcttgcagattccgaacgtttgctggcaaccattcttatcacaaacaattttgtgaatgtgaccatcatcatgctttgtaacttcttttttatgaatgtttttgtttttcattcggttctcgcagagtttttgatactgacagtcatcctcacttttctgttgttgcttttcggagagataatgcctaagatctattcggcacaaaagacgttggctttctgccgcttttccgctccggtcatctacgtcctgcgcaaggtatttgcaccgatatctgccgtactggtacattctaccgcttttttaaataaacacttcgccaagaaaaatcataatatatctgttgatgaactttcccatgccctcgaactgacagataaaaccgaactttcggaagaaaacaatattcttgaaggaattatccgttttggtggggagacggccaaagaggttatgacttcccgtttggatgtagtggatcttgatatacgtacttcgtttaaagacgtgcttcagtgcataattgataatgcctactcccgcattcctatttattccggtacacgcgataatatcaaaggagtgctttatatcaaggacttgctgccccatctgaataagggggataattttcgttggcaatcattgattcgtcccgcctattttgtgcctgagactaaaatgatcgacgatcttctgcgtgacttccaggcaaataaaattcatattgccattgtcgttgatgaattcggaggtacatcggggatagtgacaatggaagacattatagaagaaattgttggagaaatccatgatgagtatgatgatgaagagcgtacctatacagtgatcaacgatcatacctgggtttttgaagcaaagacccagctgacagacttctacaagattactaaggtaaatgaggacgattttgagaaggtggacggtgatgccgatacgctggccggactgttgcttgagatcaaaggggagtttcccgcgctgcatgaaaaagtactttatcatcattatgaatttgaagttctggcgatggacagccgccgcatcctgaaagtgaagtttaccataaacgagccttccacaacggaagttgcttcctgatttcattatggcattgttgtcggaacataaggcggactgttatcgttggggtatctggaaaacagatgaatctctcgaagaacttttggctttgctccctggtcctgagaaatacgaacagcagctaaagcgtttctcttcaccccaccgccggttggagtggctttctgtgcgtgtattgctttatcggttgctgggggaagaaaagtcaatagaatatgctcccagtggtaaaccccgtttggcggattcctctttttttattagtatttcccatacccgcggatatgtagcggttatcttaagcgccgtatccgaagtcggtattgacattgagcaatatggacaacgggtacacaaggttgcacataaatatatgcgtgaggatgaaacgatgtccgtttatcagggagacgatacctggtcgctgcttttacattggtccgccaaagaagtgatgtttaagtgtatggatgcggatgaggtcgatttccgggagcatctccgtatagtaccgtttcaggtatgtgaacgcggagaattttttgccgaggaatatcgtacggaacgccggatgaaattccatatccgatatttgctgcatccggattttgtgatgacctggcaggtggggtcttcgtttggaaaaaaatgattgattttcaatgaagtaaacaaaatgataaatcgtatcttattgctggtgcttgtcattggctacagtatgggagttgctgctcagaatcgtgtggattccttatttacatctgttagccaacgcttttcgggttatccttctgaactggtgtatttgcagaccagtaaggagatttatgaaacgggagaagatctttggtttaaagcatatcagcttgatgcgaaatcattcggtttgtcaacccagagcaagacactttatctgcaaatgttgagtgataaagacagtgtagtctggcaagagaagtatcccatagaaaacggtattgcagacggccacatatatgtggatacgaaactgccggaagggagttatcggttggaagcctatacccgtcattcctattataaagatacggtcggaatatctccggtacgtaaaatcaaagtattaaagaacatcagctataatactccggcaaaagagggagaggagacaggtgatttaagattcgaactcttccccgaaggcggaaatctggtttcgggtttgccgttttgcctggcgttcaaagctactgacacgaaagggtatccggtcgatgtggaaggggtgctgtgtgaaggcggacttcctcttatgccattcaaaagcagccatgacggaatgggaaagttactttttactccgtttgccgataaagaataccggatagagctgaaagatggacatagttaccttttgcctgaagtgtataaacaaggagtagcactgcgattattgaaacaggatcaggaacaattggagtttattatttctcaaacacgaaatttgcctgatcaggaagtctgtttggtgggtcagatgcgggggatggtgtgttgtgttgcaaagggaatgcttaaagaccgtttgaagataaagatgcctttggccgagtttccttatcaggggatagtcgagtttaccctctttgacaatgcaatgaagccggttgccgagaggctggtgtatgtacatcccgaaaagaaactgcatattcgtatcgtaccggagaaggaaagctacgctcttcgtgaaaaagcggccttacatattaaggtaacggatgataagaaccggcctgtaaaagtcaatctgggaattagcgtttttgataaagcatatagtaatccggttgatcctgtgaatattctgacccattgctatctgtcgtcgcagatacgcggtgcagttcatcgtccgtcttattattttgatgaaaagaacaaagaccgtgtgcaggcaatggatttgttgctattgacacaggggtggagacgatatatctgggagtttaatggcccggtttatcagggagaagcgtttttaagcgatgatatatcaggagttcaggttacaggaggcaggaaaaagagccgagaaaaacagggggataagcaacttgttcaggttacgggtgctgaaggtaattctgcgttcttgtggacagactcggtaggacacttcacgattgatacgaatcggatgaaagagcttcgtggtggatatatttatctgaaaccaatgttgtcgaaagagtttaagcctgaactggagatcgtagattactttccggtgattgacagtgtgagaagaaagaaatatcccggtcattcggttacagtccggacacaggcggtgaaagaagagttcgttgatatgttgtaagcagtgacagtataatcctgctggatgaagtcgtagtcagccgtaaggcacgcagaccatttagagataagtttatggggcggttagacagcatgacacagatgagcatggaaaatgtttatgtttgcggatgtggctatctgcaaaattataaacccggatatgatgcccatccttggtggaaaccttgtggtgaaccgtctgataaaaggactaaaccagtggaaggaaaacagtatgaaattgtgaagttcaagcatttgggaggcaatgccttcagtgttatagaccggcagactgtgacatatcacggtcccatatattctgaaaaagaactgctccgcatgaataacctttggcgtacgaaaggatattatgctcttcgcgaattctatcaaccggatgaagtggacatgcagttgcctataccggatgcccgcaatacattgttttggtcgcctatggttgtgacggatgagaaaggagaagccaccgtctcattttattgttcggatatcaatacaggtttcattggcatggcggagggagtggatggaacaggtcttttagggagtgataaatgcgaattcagagtgattagaaaagctaattaagttttgtaaatcatctgtgactacggacaaaagacaaagaaatctccgggagccttgtttaaaaggtgttcccggagatttttttatttctttagtttataacttagagcccccgatggacacttcttgatttgagcaatcagttcttcggtagtagcattttccatctttatccacggacgttctttagggtgatacacattgggtaatgtcttcacgcagattccggcatgccggcaaagctccggctgccatacaatggtcagttcgccattgctgtattctatttgttttcccataactgtttttatattattgaatgtgaacaccacgaagtacaatgcgtttccattccggatgcttatgtatgtatcccgcaacgaacggacaaagaggaaccaagcgcagaccttgccgctcaatgtcggtaaggactttttctgcgagctgagaacctattccgtgtccccctaaagcggcagggacttcggtgtgcgtgaggtagatttcaccattcgaggatttgatgtattctattcggggagtataactttcaatatggaattcatattgatgtttttcttcattgtctatcagttcataattttcagccataatcatttttcttttaaaagttgtttgattctacaacatttgaaggtgatattttgtttcctccgattgcttgtttatgaatcgtttaaacaattgtataccggtcataattttaacagataaaaatgattcgtggcaaaacaaatgcatactctttctgttgatattggacaaatgcggggcaacagcgctccgcctgcaaaactaccatatgggagtatcttgatttgggatactgatttctgagtgaatgaacgaattgttttatatttaaactttagagattatgaatggaagagtaatacagatcttctgcatggtagttggcatagtacttgcttcctcttgcggagacgaatgtccggtagaacaaccttactcggttcgggtatctgttaaggacaagaactatttgaatatatcgcagtttccgcaactgggcagcgtagacgagaaccagcctttccgcacctatacgggaactatttattatgctctgtacgacgcttctaccggagcattgaaaagagagtcggagattgatcaaatcaacggtgaagataaggagtatactatttctttcgccggaatacccgatggtgattataaattggctgtttgggggaacctgactactgattaccccgccggcattttgcatcaggacgggaaggagcatacggatatttatgtggcgacccgtgtcttgcatttctctcccgaatatcagacagaagaattgacattggaacgtaccaagggaaagctgttgttactctgttccaatttcccggctgaaataagtcggatagaacaacatgtaaaccacgtttatcagtcggtggatgccgatctcaattatagcggaagcacgcaggttgacaaaagtgtgccatttaccaatatgttggagacagtgcttgcaccctcttcggtagatggacattcaaagttagctttaactttctatgccaccgatacgagagcttctgaatctccttatttgaaattgcccgaaatggaagtggacatgcggcgtaatgaaataaccgctgtctctatagactacaatacatcagaaggaatctgggaaatcaagatgtttatccgtggggaatggctcacgatacatcgcctggatatctactgatctctttttccttatctatttatttaaactaaactttgctattatgaaaaaattaatgtttctggtggcagcaagcctctttgtatttgctgcttgttccagcgaagatgatccttcgtctgaagtgaatcctgaaaataatgggattacatttgaactgtccgcggttaatggtctgacagatgggattggaacccgaatggcggtgtatagccaggaggctacacagcatgtcactcgtgtcagtgtttatgcttttatgcagaacggttcgacttatctgcatcaaaagacctatgatatcaccggctggaccgatggtactactttcaaacgttttgccgttcccgatgctgacaagcttcctgcaggggtatataagtttttggctgtaggccgtgacgcaagtgaccgcttctctgtgactacgccgacttccggtaataccaattatacggatatgcttgctactatcgtgaattcgggcgatgaatcggaaatctttgcaggttcggccgatgcggaagtaatggctcagggcggaactcgtgtcagcattgagatgacccgtaaggtggccggtgtactgggatacttcaagaatgttcctcaagtgcttaacggaaccactgtgaagtatttgcgtctgaaagtcagcaactccaatcagcaggtgaatctgactaatggtgtaggtatcaatactgccgctactccttataatataatagatatggatctttccggccaggctgtttccaacggcgtgtatgtgggcaacgatttgtccggacagggagtggtgaaagtgcctaattcacaattgggaggttcgttctatatgccggttagtggcgtgagcatgactttaggactttatgatgcgagtggtaccgctataaaagagtggaccgtgagcgacactaatagttcgggagcaacacagtttaatctgatggcaaatcatttttatgcattaggtgtgaaaggtgctacgggtagtgtggatggcggaacaccgggtaacccgggtgacgatgatgctccggtagatttgctgaccgatcagaatattgtgatcactatcagtccggcatgggaattgatacataacctggtaattcagtaaaagtaactcaaaaacagaatcatggtatggctatgagaaaggcaggctatataactatccttctgacgggatttctggcaacgctcttgttgggcagctgctcaacagatgatgttgccgaactccccttggaagaaggggttccggtccgttttgaaataaagcgggacggggtcatgagtcgtgcgccgggagatgcagctctttctgtcaacaggatactgattctgccgtttcggaaaacggatgaagcattgccaaacgatgcagctaatttcgttccggaatatagcgcagcccgacaattggatgtcaattcgtttccggcagtagtcacgatgcttaatctttcagcagcctctacctatcagttgttggtgatcggatataatcggagtgattatgattttgccagtggcggaggtgcaacgaagcggtttaatatcggttcgactggtaatccggttacgttggctaatttgtatttgcaaccggtcaatccgacggtagttccggagttcttttcgtgtttcggaaacggttaccagggtacaacgttggttggtcctgtttttaaaccttcgcaaatcaattatgtgacaggtacactgaaaaggctggttagtggtttaacgctcgaagtgaccaatattcccgcatatgtcaactctatgacattgatagccgagcaacttgtgacggctacccgtgcaacggatgggacggcactggcatggcaaacagccggtgacagcggtataaaaacattggctactcaggcaccggtttcggggaaagtcagtttcaaccagtttctgctggctattccggacagtagaaagactctgttctatctggatgtgtcttcttatggactcttcaccgaacgttatacggtgaaactgtcggatactcccggtgtggtttcgggaaaccggattatttttactcctaatcattgggtgaaagtgaccggaagttatgcgaatatcaatataggtttcactttggcaggaaacatcaacttggatgacaatgcctgggatggccttcaatagaaactgaaagcaaaaagaaccggagatgaaaacgaaagtgataataatgataagcctttttctttctctcttcctgacgggatgtgagaaagaactggtcgaagtgcccggtgaagaccccgggcaacttcctccggaaggtgagccttcggacttgcccgacggatattttgaagtaaccttctctgccggatacggaggaggggatacccgtacacccgtcacggggaccgattcacgggttcgtcacctgcgttacgtcatttataagtcgacaggtgagtttgtgaaagaaaaggtggtgctgaagactacggatgctgctccttcctggccgatggctgccttgaaagatacgcttccgaaaggacagtatacagctgtatttctggccaatgtagagaaaacacagttcccgattcccgtttcgggcggtggaaccaactatgcggatgtgttgacgaattaccagacaacacgtgcgaatgcccggatcgtgttacccggtgcggagtttaccgacacttcggaattttatctggccaatgtatctttctcggatacctctgcccaaccttatgtactgttgcagcgcattatcagtatgctgaatttgcgaagagtgtttgtggatgcacaaaccgctttgaattctctgaccaacaatattgtgacgcaaataggatataggaatataatccggacgacggtacaaggcgttttgccagggttactgaaaacggcaatggacttgggagtggttggtaatgctgtctataatgttgttggcggactcgatgccgcagtcaatctggtggtggcggcattggtcgaaccggtcgtggatgtactgtatgcacaacttttgcaagggttggtcaatcagatagggctgactctctccggtaatgctacgcagaatggtgcattgggagcattgggcgatttactgaatccctggaggggcagtgatgctgcttatgctttagtgaccataaacaatttccctaagactgtggacttagacctgaatgtgaaggatttctatacgggtaatcatcgtttccggtacggattcacacctacacccggtacgacgaatagtgagaaggatattctgatcagaggttttcatggcctttatgacgtacgggagattcatgttgccaaacccggactgatctccggattgttggtggacgatgtgattgacggtccgttgttgctgaatggagtatttgtgaatatcacagatccgatacaggcaacagtcaatacgaattacaggtatcgttcgaactattcgtttgtcagcctggggctgaaatcgtatgcacagcagaacgacggaaaccattcgctgacactctctgtacagttgaagaatattgctaacctggatggtatattgggaggaatccccttactcggtcccgtgttgaatggaaccgttaaattattgattggcaatataacggttaccgttccggtgaatcttcctttgcttggaaccgataacctgacgctgtccggtagctggagcacaccaccggtgcagtattaaaaaataaaaggggttgtgtcaaaacgttgacacaaccccatgtttgtattaattatttaaaaactatacttgaagggaaccaatatttacctgtatagtcaattatttgcttttgtgttccggattggccatcagctacataaatattagtatttaaataatgcgtaccatagccatcctcagtgtaaataagatagacatctccattttgaggattcacttgtattcctgcaccatatattgattgaattttggaaggggctttgaaaaattcttgagcaatcttgctttccgtattgtatttgtagatgttttttccatagtaactatcaccataattacctggcacagtagtagtattaactatatacaatgcattttcagttgtagatgcacataatcctgtaggagtatatgcccattgattataaaacacatttatattatcaggtaactcaacagtggcttcgtccaacgttttaggattgatttttattaacgattggccgttggcggcccagatatttccatcttttgtctgcgcgaatcctgttttcattaaagcggttagttttttaacgaaagagaggtcggaagctttgtagatctttattgtatccatattatttacgaatacataatcgcctgactttaagatgtctttacagccgttctcgttggctgactcgctattgagttgtggcagcatattgccgatagataatggatttaaattaattttataggcacctctgcttgcggtcaatatacctgtagtttcattaatcgtgcagaaactgttcgcttgtccgtagtctaattgttcttctatttctgtacttaattgtttggtgatattgaagttagccagctcgatttgggttagatatggagcatttttagctacaatatacatatatgaatcttgaatgactccgacagttcctgtttggccaagtgattcaacaatgttaaagttccattttccatctttataataattgacagaagctgaatgccccatagatccttcgttaatcacatagaaaccaccgtaatatgcgaaaacatctactgttatctgggctttatccgtgttccctttagagtcttgtgcttcgaaaatgatctcgtgttttcctccaaccgaagtgctgaaagtgtagttaacctcattggatacctctttaccatctactttccaagaatagattttagggttaattaggtttagggtaggctttaaagttaaatcttcacctttagcaatgatagtgtcattgggaagactcagattttcgaaattcgtaggataataatatttatcatcatcgtcattacatgaagagatgattattggtaaagcacaaagtgcaataaagcacattttagtaattaaagcatttacttttttcatgttacaaaaattaagtatataaataagtgagataattatttcttgtagtgcaaatcttccaccgcctgtatctccgtagaagcttcacccagccagccgcagttctggttgacggctgtataaatcttcacgaagtcgataccgtccagatgaaccggcttgccgtctttatctaccgcccagtctatcttgaattgagaatactccgtattgttcgggtggttgtcggcatatccccaggcataacagtagcctacccagtgctcgggcatacccggacgtggctcgttgatggagttgtccgccaggcggcttccgcggaatgtgatttcagccggcatccatgctggataataagaaccctgggtgtgatacgtgttccggtagatgtatccctctttgccttgattgtctttccacttcacatccccgtctgccggagtgggacggtagtaagtgatttcgtagttgcggatggtggcaggcgagttatattcgcttcctgccaattcgtaccactcatcatccggctgtccgttgccattcgtgtctttggatacgagtacgattcccggttcggagtttcctccgggtttatccagcagcgtgccatacatatcataataggcgttgccgtatatcttgaagtcatattcaccggggacgttgcggatggtatggtcgaatcccacggtaatgttgcccccgaatcctccgagagtgaagaggcaggtggtgcggtcctgcagcagttcggtggcgcgtgccaatacctgaacgtcggtgaatccctcttcgtaagctgtataagaggtattcatatattgtgatggcgccggattgtactccaatactttattagcgaaggcacctgcttccgggtctgcgggattttcgtcgggattgccttgcgaggctttgttccggaacaggacggtattggagttgattcccacattgggcagcttaaatataagttgtccctgcgggctgaagcagagcacatcacctttcaccttgtagtcgtaagcgtcggtgatgtagatgtttccgctgtaagggttgacactgatgctgtaaggagtacgtatcgtggtgccgtccgtgatgaagttttcccgttctgtctttccggttttcaggttgaacactttgatttgcgagtcctgagtccggtaatcataattgtataaataggccatgttgtcgtggatggtgaaactcaacaccttttcgtcgaaggtccgtaccacttgatcggtatgaccgtctatttgcacgaagtgatagtcccccgcttcgatattctcgccgtgcgtggctacatagatgtttccgtccggtccggcctgtatctttcccggattgggacctacttctatcttcttgatttcggtaaaagaagggatgtcgatcacggataccgtacggtctaccccgatgccttcccagtccagacctccggagttggagacatacaacttcccgttctgcacacaaatgccgtcgggattcctgcctgcccgggtcagtgcatcgatagagagggaagcggtatctatccgcgcaacggttccgtcaaaggagcatacgtatgcttttcctccctcgaaggcgatgttacggggttgccgggaactgccgttctccgataacatcggtatctgtttgacagactttccgctttgcaagtcgactacttctatctggctcgatacattgactacgatatagagtttgctgccatagatggccatatcgttggcggtatctcccaggccgcgtcggttgatgctgcggaagtagtcggtattcagctgattgttcttgaaggaatacaaagcgagcgaactgttgttcaggttgaagagcccttcgctgagaatgtagagttcggctgttccggtttcgacaggcataccgtcgccaccgcccgaaggagtatccgtgtcttccaggtcgtcacacgaggcgaagagaagcaggaagaggaggaaaaggaagctcccgcctccagctcctctccggaagcgaggagaagaattgcttctgctgttattaaatgggttcattttcatattgctgtttcttttgataattactgattcaatgtctgaagtatctttagtatcttactttcattgtcactctcactgagcgtcccggcatggggaagttttttactatctcgtaattcttgtccagtaggttcagcacttccactgtcagggatgtgtttacattacggatgcgctgatcgcggctgacggatacactatggtcactgtagctgtccagccggttttcgcggaggttctgccccagcatatagcgcttgcccgaaaagaggaacgagtaggagaggttcacccacggagtctcgataccggcttgtcccgatccggatacgcggggtgtataagcgatttgttgcttgtaggtttttcctcccggttcggtcatatccaatgcgcgctggtaagtgtagttccccgaaaggttcacccgtagtttctcccagggttgcagactgatgtttccggcaacgtcgattcctttgatgtccactttgccgaggttcaccatgctccatataaagaggttcttggtgggtatggctatgattttgtctttcaccttattatagtaagcatctgccgtgacggatacataggggatcagttcattgattgaccggctgtatgtcagtcctaagttgtattgcgtcgtgctttccggtttcaggttcgtgttgcccacctgtccgtagtacaggtcgttgaagctgggcaaccggaagatgtctttatagaacaggcggatgcggaactcttcgccggcaaagggcttgaacgacgcgctgacgtacggagagagtttccgtcggttggctgcggcgctgccttggcgcacctcctcgttgatgaccgttgccagtaccgaggccgaagcggtcaaccagtcgttgacgtattttccggcaaaggccgtcaaccacgaatagcgggtaggatacgcaaaatctttcaggttcgcgttcagccggttgatgctcccatccgtcgagagtgaaaatgagaggttgctgagcacccggtagagcgccgaagccgagaggtaatactcttgttgataataactgttttccgttttgccttccgaacctttataatcaggatcgaggtaacgttgatagctccagttccacttagccgaagtctggaaaacccattggcggttgaactccttcttatattggctttgcacgaagacattcttgtcccagaggtgctgtgaagagtagtcgtaataataagtggtggcattgggcagtccgcgggacgactgataatagtaggctttcagccgccattgttccgtatccgaaaagttgccgaacaatcccgcttcggcacggaggtttttcacttccgtgtttttccgtttctcgcgcgagctcaggtcattgttttcgccataatgcaatgtgaaagggtagtgcccgtcagccgacatccactcgccgttggcggagagcacccatttccggttcagtttctgttcgatcaggagagacggattgaccagtccccacgaacccgttttgaacgaggcgctcaggttggtacgccggttgtctttgaattgcggtgtcagcgtctgtatgttcagtatcccggcggaagcgaaaaaccttgcgggctgaaagatgttgtcgctctgtccgttgctgagcgagaggcggtctacattgtccagtgagaagcgtccgatgtcgatctgccccgtctggcagtcactgattgttattccgtcatatcccacggcggtatgctcggctccgaggcttcgcaatgaaacggttttcagtccgccaatgccgccgtagtctttcaccgtaactccggcaaagtgcttcacggcatccgatacttgcaatacgttgaggcttttgagttcttctttagagaacacttgggtgggagccatcgctctcacttcgcgggtgtggtaagcttcggcaacggttacttcggggattgaataagtacgggcggtatctgctttctgctgttgggcgaaaagtgaaacggtaaggccctggcagcaacagaaagcaacacaggcgtgtagtagcttaggcaatctaaatatattcatctttgttttttgttgttaaaatgtccggacgaactcacttcggccggacatactaaataaacttggcagagtttattatcataacttactttctctgaatcagagtgatgaatgaaatgacggatggaataattccggctcattagactcaacgctttttcctcgaaagcaatgaaaaagatgcacaggcaggtcttctgactcgtttctgttgataagcgccttcccaggaaaacgtttcccagtggcaagtggtggttgcttacaacaatctgatgtgaaacttacagcagcgggactgttcaggatttgcacctgattcccttttaattgcatccccggtacacggagaatacaaaccaatgcactgcaaagataaaaagaatattagaaatagcataataatttgtgattattcgttatgcattgcggaacggacggagcaacatcggacaggtcatccggataatgtcagacggcacatcggaatgacttagataggcgatgccatttatcttgattccggagggttatgatggcagaatgatggttaatcagccttttgactgacacactctttctttaaaacggatgaaccggagggaaaacaaggggaaagccggtcttttctgttccgaaagccgggctttgggtggattagagtcggggttttgcggaaaagaagtaagcattcactccaaaagacggttacatttgccccgaaagaagtaagcattttccgaaaatgcttacttctttttcaaatatctctatatgttatgctccattacatatattgttatgaaaaccggggcttataactcccggatcttgctctcgttgctcacccgatatgatcgttccggaagtgtcggaaagagatggtttcaaggttaaaacctgctttatggacagaacactttccggtctctttctttcggtaaacaaaagcgggaaattgcgggcaaagagataaccggcaaatcgaattggagacgtttttgagaggcatatcgtgcgtcgggccgaaagaacggaaaatagagagggtcggattatcattctgtcaaaatgataatccgaccctctccgcatctttggggcaaatgctccgctccggtatgtttttcttaaccgcgctctgccagatattgctctaccttttgcagggtggcgtctttcaacaatacgattttgttcttatccagtaagtagagggtgggaatagccctcaggtcatacaggtttttgtttttgatgaccagctccttatcatatccgttggtccattctttcgcgaaatcgccccggtgctttttccattcatccagttcttcatccggatagagagacagcaccctcaacttcttgccggctatgaacccgttgatgaccggagagctttttaatccctctatcatctccgcgcaagcgtggcatccggggttgttgataaacagcagtgtgtattccgccgggaactgatgaagcgtaccctttgcgcccgaatccagtgtataggtgaagttgagggcttttgtgcccaaccggttcttttgcgccagttccagccgcgcctgcgggcgtatcttttccgtttcattcagggtaggggaggcaatcaaggtttccagtacggggatgtaaagctcttcgttacgcatgggtgagttagggtcgtagaggtatttatcggccaattctgcaaagaagtccagcattcttttgtttttctccgcccggttgaaagtctctttcatagcagtttgtgcgacaggtagggacatgtgttccagtaggtcgcaataatccacccaagcctgttcggcaacttcgatctgactgatgtaggtggtatctgaaaagtcgaaacgatcccaatagtgcttcaccatatagtctgcacgctgttctacggtattcagtactacaggtatttcgggtaatttgaaaattttaagcgtatcttgcttctcggactgctcttggctggagacagaaccgcttttacaggcactaagtgccaataacaaggcaaatgaaaggtattttacattgcttatcataatcttttgttttgatatgggacaaagatagtatttttattctatatttgtacttaatcatgaaaacgttggacacacaacaagcaaattgaacatgaagaataaaaaaggacaatcaactacagaggcaatctttagaggaatacagtcgggaaaagtattagagctttttgacaaactacaatatcagatcgcaattcatggcgaactgacctatagtgatccttggggagaagtacatctgttcagggatcaaattgaaaggacgaaacgtgactcggattcaccaacagcgatagggcgctatccgtttgccgatgtatggatacgattctacgagacggaagtgaaggattattcacttctgttagagatgtgtcttgtggcatcccattcgcagacttgtgtctggcgtaaaggtttcggtacgttgctcgataagttatacggaaaaatacctttggtagagtatgaacaggcattgaggcgtcttgcgcacccttatgccctgagtgaaattctctgggccttggagtgggattatcgtgaccaggaggtgtatctgaagtactcacattacattctgctccacctgcttccattgcttaccccccggaatatcaccttcctgtacagtgtgcgtgagtggtttggctctaccaatgatcatcgtgtcgtgcttgttcattgttattggatagactgctggctgaaacacccgaagcgtttactgaccgatgatgaatttacggccgatttcaagatacgctacgaactgtatcgtttgtgtaacttcttatcttataaggaagaaccttatccgcttgaatttcctattcgtgcagtcgacttcggaagagcctatcaaagaggaatattgtctgaagatatgttgattgttgaactgatggatcgtccgatttcgcctgctttgataggagagtctgtgggctttttttataaaaaaaatcaaaaggagaaacgacaatataccgattgccgggattatgatttcagtggttttaagaaagtgttggaaaaagtgacagagcgtatcctcgagatagagttagaaaggggagaagcccgtactgaggtcacttcgttggctcagaaactggacggcgtgttcggggccgaagtaatgattcgcttgttgagtcttatggggaaggaaaagttcgtacggcttgataagtggtattacgacactagtgaaacccgtataggtatgttctgttatttgatgttgcattgcgctcctttgccgacagatacgtcggactggttgaagatgcttgtcgaacgtgccggtatcactccgaaacgtctgatggagatggctgtatattctccccgttggctggagatggtagaagaagctaccggatggaaggggctgacttgtgcggcaaatttgttctatgcttacacaagggagtgctaccatgatgtagatgagacaagaattaatccttatactattctgtcgcctctggagatctctatgggagtggtggatacggcttggttttggacggcatacaatacactggggcgcgaacgttacgaaaaagtttttgcggcatccaaggcagttacgggctcctccggtgtgtatagccgattccggaagtatacagatgcgcttgtcggaaagtatacgatagcgcaattggaaagtttggtgatggacaaccggaataaagattgggtacgtgcctatccgcttgctccatttgccggaaaagcgcgaaagaaagaggtagatgcacgacttcgtttcctcaaggccttctggataagcagtgatagcctgtccggacgccactctaccgaaaaggaggccgtacaggtggctatagataatcttaccggaaattccggtctgaagaatctggatactaagtggtttaaagagagagtttggtgaggactctacttttctttggccagtgtaaatacaaattccaagccgcccccttggctgttcttggccgatatgcttcctccgtggatgataacggcattcttgacaatggccaaacctaaccctgtgcctcccaatttgcgggagcgccctttgtccacccgataaaagcgttcgaaaagacggttcaaatgttcgggcgatacgcctatgcctgtgtcagcaaagctgaagtaatagaatttctcgtcttcacggaaacagttgatatgaatttggatattgtttccggcataagcgatggcgttgtccatcaagttgcggaaaatggaatagagcagcgagtaattgccccgtatctgaatctcctttttcagtgaattgactaccgtgatgtgtctctcttccagttccagagatacttcgttcacaatattagttaccaggacattgatgtctatcttttccatatcgatcatgttggcggcttcgtccatacgcgtcagtacggagatatcacgtagtagccggctcaggcggttgctctgtgcgtaacagcgttcaaggaatacattcattttttccctcgggatgttttcattgttgacaatagtttccagataaccttggatgctgctgaccggggttttcaattcatgcgcaatgttttgtgtcaattgtcgtttcaagcggatctgctcttcttcctgagtgacatcgttaatgctgatttcaaagctcatatcctggaagatgatgcactctacgataaaagtttttccgtttttattgatggtgatagacattcgtttctcttccttgccgacaggtcgtttgggagctttgttaatgaagtccgttatctctttgagttcgctgatgttgaatacttcttctgccgtttccaggtttgagtccgatatcagattgctgtattgggtaaacaagttgtttaccagaatctcttttttgtctttattgaatactcccagtccttcgtgagaaatttgcaggtgtgtgatcaatttctctctttcgatataaagcgcctctttcgtttcgtggagacgtttgtatatctggatgatgtgttgcgaaatctcacccagttcattgtgggggaaggccgactgcattgccatttcgatgggttcattgcggtcggcgcgcatggcgaattcgcggagctgactgatggaagtacccagcttgttggtaaacttatagaagatgatcatcagcaacagggtgacgataacggtgaaccagatgtaatgcgggtccgttttcagattattgatcaggctgacactgtagggcagagccgagcggatgatgtagtccttatataaggtggcggagtagaaataggggactccggttgtttcggaggtgcgacgtacatcgaagccgaccccattgtgcagggctttttgtacctcttcccggtcgaggtgattgcccaactgctccacattctgttcctgactgtcgaaaagcacttttccatcgaggtttactacagtaatacgcaaatctttcaatgcgttatgttgcaagtaatcggagatcacttcagtcatatcctgtgggtgatcgtgcaacttttcatacagcagattattgcaatcctgtaactgtatattcaataactctactttatactctttctcccgctgatactgataagccatgaagcaagcggcaaataccaaaaacagggaaatgaccgaaaggaataacttccggctaaaagagagaaagtgcttttgggtgacaggtaggttcatatatgtaatgttttgagtattattcaccacagaggacacagaggttatatggatgtttaagagaaagatattctctgtgtcctctgtggtgaattgtattcgtttctattccgtttcgaagcaataaccgtatcccagacgagtgacgatacgtttgccatagatgccgatttttttccgtaaccgggtgatgttgacgtctatggtacggtcaagtacatagacctcatcgctccagatccggctcagaatatcttcgcgcgagaaaacacgtcctttgttctgtagcaacaagaagaggatttcaaattcctttttggttagcgccacttcttcaccattgatgctcactttctttttggtaatatcgatcaccagagactggtagcagagttgttcgggtgctttttccgtatccgaggtagcagtgcgccggagcacagccttcacgcgggcaatgacctcacgcaaggagaaaggttttgaaatatagtcgtccgctcccaggttgaatccggtgacggtgtcattttccgtatctttggcagtgatgaatataatgggaacctgtgctgtctttttatcttttttcagcagattggccattttgaatccggaaatttcccccatcatgacgtccaataacagcaggtgatagctgctgatattcattttcaaggcttcttctgcagagttggcagtatctacttcgtacccttcgttctcaagattgaacttcagaatctcacagaggtcttcttcatcgtcgaccactaaaatacggtaatcgttcattgtattctttgttaatgtaatactacaaagttaaactttatttcttttcttctgcaaagatggaggctttttgttacgaggggatgaaacacgtattacgatttgattacatttccgagattcgggagacactttatcaacaaaaatgttgtatctttgttctgtcaataaattgaaatatcaaaatgattaagatagatttcaagcaacgcaaacgtgaggtgctttggacggttgtcgctttgttctttatagctataggagtgtctgtgttcaagttctcttccgcaacttccggttttgagataactgacgagctgggagggaatatttttccttctgctatcctctcggttgctacgaccgacgcccaggttattcaaccggctgactccgtatatctgggcaatcctaaatcgtgcatagccataaaaataaagtcacgttctgcttatagccgtgtgcggatcgatgttgcggaaaccccattcttttcacgttcggtgtcggagttcgtgctcaataagcctcgtacggaatataccatttatcccgatatcatttggaactacgaagcgttgaaaaacaataaccaggcggaacccatcagtgtggccgttacggtagaaatgaacggagaagatctgggacagcgtgtacgcactttttctgtacggagtgtcaacgagtgtctgttggggtatgtgactaatggcacaaaattccacgatacggggattttctttgccgcatatgtcaacgaagagaatccgatgatcgaccagttgcttcgcgaagcattgaacacacggatagtcaatcgctttctgggctatcagaatccggctcccggagctgtagataaacaggtatatgcattatggaatgttttgcagaaacgtaaattccgttacagttcggtgtccaacaccagcctgtccagcaatgtggtctattctcagcgtgtacgtacgtttgatgacgcattggagtcatcgcagattaactgtgtggacggtagtgtcctgtttgcttccttgctccgtgccatcaatatcgaaccgattctggtacgtactcccggtcacatgtttgtgggctactacaccgacaattcacataaggatatgaactttctggaaacgactatgataggtgatgtcgatctggacgactttttccccgatgaacaactggattccactatggtaggtaagtcacagaatcaaatgtccctgctcacctttgagaagtcgaaacagtatgccaataagaagtataaggaaaacgagaaaggtattcattccggcaagctgaactatatgttcctggagatttcgaaagatgtacgccggaagatacagccgataggaaagtgacctggagacgccaaagtaaaatggaggcggggacttacttaaaaaccgattcgtacggctcgtagctaaataatcctaataaaactctaatatatagattcgtttcatgtctttgttgtacttttgccgttcaatatttggatgtattccaaacacacgttagaatgaaacgaagaaactatttcatattcagctgtttgatgctgatggctcctgcgactgtgcaggcgcaatttgacaaaggcctaaactataagattgaaaccagtgcaactgtaagtggtgggcacaacacgcctttttggctcgtggcaaataagcacgggctttcgtctattcgaaaaaacaatgcttatttggatgcgggtatctttcgggatttggagaaggataaaaagttctcttatgcctttgggttggaaatggtgggtgcaagtcgcttcacttctaaattcttcatccaacaggcttatgtggatttgcgttatcgggggatggaaataagtgtcggcagtaaggagcgtggcaacgaaatgaaaaatgatcagttgagctccggtagtatgactttttctaccaatgcccgtcccattccacaagttcgggtttctatacccgagtatattccttttccgtggaccaaaaactggttgcatatcaagggacacgtagcttatgggatgtttacggatgaaaaattccaggagcgtttcactgccgggcgttctaaatacacgaaagagactctgtttcattcgaaagcagctttcctgaaggtagagaatctgcagaagtcacctgtttcggtggaattgggtatcgagatggcagctcagtttggaggcgattgctattatccggacgggacggtgttgcgtacaccggacagttggaaagactttttccgtattttctttccaagcaacggagacagtggggcttcggagagtgaccagataaatattctgggaaatcacgtcggaagttacagtgccgctgtggggtatcattttccaacctggaaaataaaggcttactgggagcacttttttgaggaccgctcgggaatgacactgacttatggcatgtggagagattgcctgaccggattggaggtgacgttgccggagaatccttttgtgaaaacgattgtcggagagtttttgtatacgaagcatcaatcgggagctttccattactttgctactccggccattgatcattcgtttaccggagccgataattattacaataattcgcagtatgccggttgggaacattggggacagggtattggtaatccgttggttacctcacctatatataataaggatggaaacctggcttttgagagtaaccgtgtgaaaggattccatatcggtttgaatggcagtcctacctcagagatagattaccgcattctggtaagtgttgctaagcactggggaacttacggtagtccgtaccggaatatcagaagaaaccagaacggattgttggaggtgacttataaacccgaacagattcggggatggagtttcacgctggccggtgcggtagacggtggcaatatgttaggagaaagttggggcggtatgctcaccattcgtaaaacaggtttaattggtaagaagaaatgaaaaaaggaatcctattgttgtttgtcgtcctgatcggtttcacgtcgtgtggaaagaaattcgggcatcgctatctggatggaatgtggcagatgcaacgtatagaatataaagatggtaatatcgatactccactggacacttatttcagttttcagatggatatcatccacttgaggaagttgggtaatagtgagttctttggaaaatatgtctacgagaacgactccatgcacatacaagtactcgacgctacggcggaacagatgaaagttttcggcatggatggccgggtacaggactttgccgtagagaagctgaacagtaacaaattggttcttcagtcggactatgcccggttggaatttagaaaatattgaggacgctaaaaagctgtcttcattcatagatgatgattggaacagccggttcgtgagaatcggctgtttttttatgttattttttgcatatcagcgatgggattgttacttttgtaaggttatcaacattcagaaagcaatatgatacaaggtaagaaatttatctccccggggacatggttctcaatgatatatccgtcagactggagcgaatttgaagacggcgaaggctcttttcttttttataatcccgaacattggacgggtaatttccgtatatcagcctataaagaagatgctgccgcaccgggcggtatgaattatggaaaggatttcgtccgtcaggaactgaaagaaaacccttcggcctccttggtgaaggtgggacatttggaatgtgcctacagcaaggagatgtttgaggaagagggtacctattacaccagccatctttgggtgacaggcattgacaatgttgccttcgaatgctcgtttaccgtaccgaaaggagaacatgtggatgaggcggaaaagattatatccagccttgagatccgtaaagacggacaaaagtatcctgcggaaatcattcctattcgcctttctgagatctatcaggtgaacgaggcctacgagtgggtgacagatacggtgaaaacgcaattgaaaaaagactttcagggactggaagaagacctgcaaaagatacaggatgtgattgacagtggcgttctctctcctaagaaaaaagaaccctggctggcgttcggtatcgccatctgtacgattctggctaatgaagtggagggtatggaatggatgacgctggttgacggtaaccgtgaagtgccggtgttgcggtatgaaggttcggaacagttgattgatccgatgaaattactgtggagccgggtgaaagccggagaagcctgcgaagtggcagaggcatataagcaggcactgatacactaaccacctattatcacattcgattattatgaccccttatttacaagtagataatcttaccaaatcttttggcgatttggttcttttcgaaaatatttccttcggtattgccgaaggccagcgtatcggcttgatcgctaaaaacggtacgggtaaaaccaccttattaaatatactctccggaaaggaaggatatgatagcggcaatattgtgttccgccgtgaccttcgagttgattatttggagcaagatccgcaatatcccgaagaattgactgtgttggaagcctgttttcaccatggtaacagtaccgtagagctgataaaggagtacgaacggtgcatggaaaccgaaggacatccgggactggatgacctgctggtacgtatggaccatgaaaaggcttgggagtatgaacagaaggctaaacagatactttcgcaactcaagatacggaactttgaccaacaggtgaagcatctctccggaggacagcttaagcgggtagctttggccaatgctttgattaccgaaccggatttgctgattctggacgagcctaccaatcatctggatctcgacatgaccgaatggctggaagagtatcttcgccgtacgaacctcagtctgctgatggtgacgcatgaccgttactttctcgaccgtgtctgttccgaaatcatcgagatagacaaccgtcaggtttatcaatacaaaggaaattacagttattatctggagaaacgccaggaacgcatcgaagcgaaatcggtcgagatagagcgtgcgaacaatttatatcgtaccgagttggactggatgcgtcgtatgcctcaggcacgcggacacaaagcccggtatcgcgaagatgctttttatgaactggagaaagttgccaaacaacgatttaacaatgacaatgtgaagctggaagtgaaagcttcttatattggcagcaagatattcgaggctgatcatctctataagagctttggtgacctgaagatattggaagatttctcttacatcttcgcccgttatgaaaagatgggaattgtggggaataacggtacggggaagtctacttttataaaaatattgatgggacaggtacagcctgacagtggtacactggatattggagagaccgtacgtttcggatactattcgcaggacggattacagtttgacgagcagatgaaagtcattgacgttgtgcaggatatcgccgaggtcattgagttgggtaacggcaagaagctgacggcttcccagtttctgcaacacttcttatttactcccgaaactcaacatagttatgtatacaaattgagtgggggagaacgccgtcgactttatctctgtaccgtgctgatgcgtaacccgaacttcctggtacttgacgagccgacgaatgatctcgatattattaccttgaatgtgttggaggaatatttgcagaacttcaagggatgtgtcattgtcgtttcgcacgaccgctactttatggataaagtggtcgaccacttgttggtattcaacggacagggagatattcgtgactttcccggtaattacagcgattatcgtgactggaaagaagccaaatcccaaaaggagaaggaggcggagaaaccacaggaagaaaaaacagcccgtgtccgcctgaacgagaagcgcaagatgagtttcaaggagaaacgggaattcgaacaactggaaaaggaaatagctgagctggaaacagagaaactgcagatagaagaactgctctgcagtggtacgctttcggtggacgaactgacagagaaatcgaagcgattgcccgaggtaaacgatctgatagacgagaaaaccatgcgttggcttgaacttagcgaaatagaatcatgaacctgaccaattatcatagtcataccctctattgtgacggccgtgccggcatggaggattttatccgttttgccatcagccgagggtttacgtcctatggtatttcttcacacgccccactgccgtttccgactcattggacgatggagtgggatcgtatggacgactatctggatgaatttacccggatgaaagagaaatatgcttcggaaatcgaactggctgtcgggctggaaatagattacctgaacgaagacagtaatccttccgtccggcgtttccaggagttgccgctcgactaccgtatcggttcggtacatctgctttacaatgaccgggatgaagtagtggatatcgatgtatgtgcagaggtgttccgggatatcgtcgatcagcatttcggcggtgacctcgaccgtgtgattcatctgtattatgaccgtctgttacgaatggtcgaactgggaggatttgatatcttaggacatgctgataagatgcatcacaatgcagcctgttaccgccccggtctgttggacgagtcttggtacgatgcattgatacacgactatttctccgctgttacagccaaaggatatattgtagagatcaatacaaaagctttgcatcatttgaatactttcttcccgaacgaacggtatttcccgttgctgaaggagttgggagttcgtgtacaggtgaacagtgattcgcattatcccgaacggatcaatagcggacgtcccgaggcattggccgcgttgcagaaagcaggctttgaaacagtgaccgaatggcacggggggaaatggatagagatgccactttaaaccaatatatcatgaaacacaaaaacttattgttagctttgccgtttgctttctttgtacttgccggcatatcattgtcctcttgtaaagacactcctgtccgtaaactttataaaagtgatatagactggaaacttacctggcaggacgagttcgataaagacggtgcacccgatcccgaaaaatgggtgttctctccctggcatcctttttgccgggataataactttgttacgttagtaaagggcggtaaattgattctgcgtgctttgcccaataacgatccgaatgatacgatccgctacatggctggttgtgttgagactttgggcaaaaaagacttcttgtacggacgctttgaagtgtgtgccaaactgggtagtgctaaaggttcctggcctgctatctggcttaagcctactgactctacaacgtatggtgcgtggcctaaatgtggagagatcgatataatggaacaactgaacaaagatacgtttgtctatcataccatgcataccgaatatatcaaagtgttaggacataaaacagatccggactattatactactgcatcctacaatccgcatgaatttaatgtgtttgggatggaatggacaccggataaaattgatatgttcatcaatgattcactcactttcagttatccccgcattaaagaggagggggctgtgcagtggccattcgatgttcctttcttcttactgctcaaccaggtactcggaggatgggccggagagatagacgacgcggagcttcccgtacagatggaggttgactgggtgagatattacgaattgcctgaaaatatgaaatagtcggaaggtagatttttagatctctcctttgggaaaaacagcttgggaaaccggggcaccgtctgcacgataaagataggctcccggtttttttataggtattctttttccgttatacagtttgagagtcattggctgccaaacagcgacgtagtacatttcgtcgataaatgccacctgtgccttttcgtcattttgcaatacctgtacttttgaaatatcgaatgcagccgtcttctcctgagtggaagccgggagcaccaaataccggtaagtggcagggatacctgacggatgtttgatgtaaatagagaaaatttcatcttccaacatccggggagcgtacattcccatgaagtcgtgccactgtcctttcttcttttctgccagtgccaggcaaagttcgtcctgcagaaggatatatccggtgttgtcgtggaaataacggcggtttccttccgtccatatttcaccattcttgaaccgttgatcgatggaggtgataagtgtggcagtgctgtctgcatggatatcacttcccaagcacaggataaattcattggtgaatatccatactttgttcgcggatagcccgttacggttcaagtgcatggcggtgattccctgttttccgtttgttgctccacctgtgaaattggttttgttgcgtgaattcggtccgttgtctatcgggatgggagcattgctttcataggttgtgataccgggtatccggcgccagttccagaaagggaaaatattgtggtattcatctcctcgaatatacgtatagacagctccgtctgccatgtaatatcccttcaggttatcctcatttaccagttccgtaccaattacccggctggatgccatgcgtaaagatgccatccagtcagaggtacggtgaatggtcaagtcggaatctttgaagaacttatttcctgtgaaatcgttttctgcatccggatgtaggaagttgcgggctataaatgcctctatttcctgtgtctgttgttcattgcttcccttcatcagtgagcaggctgcgaagagcaggttgaatgatttgtgaagatcggcgctgtggaagagttgccggttcaatccgtttacgtcccaatgacctttccatacaatccattgataccctttcagaagaagggatacaaggatatcctgttgctcttggctgaatgcaagaggggtgccggcaaacagttcggaataaaaactcatgttgcagaggaaagaaagtccgtaattgccgaactgttgttggggaccatgctgatggaaactccagtccggctgaataccctctttctgtcccaatacgatttccgagccaatgttttcccgtgcctcttttaccagttgggagtcattcaagagtaagccccggatcagtacgttgcctgccagccatactttgttctgtcctgtcatgccaaaatgggattgttccatcacccgcacggcttcctgcttttctttttccgtcatttctgcttcgaaaaggatgaaagccggtcccaaggtgcggggaatacctatttgattataccaccagtttttgcaggccagttttttggtgaaccagtaattcatggcttggtgaataatgctggtcacggctgaaatctcctgtgcggaagcattctctttttcgcgggcataatattgggttagtttcagtatccgttctgcgtgttgtttcggttcccatcccgaacgtttggtatcaacatagttgatgtccggccatgaaccgtctccccgtatcgtactgatcagtcggtgtatctcttcccggtggatagggtaaagttgttgaagttcgataacgttctggtcagatacctctttttcgggaggaattttagataatagttgtaagaaaggttgtttgctctcatccagtccgataaccgaccggatataattctgcttgataagttcgctttctttgcctgtttgtgcagtaagatgagaaaggaaagtacagataaacagtactgacaggaagattcttttcatatatcgtgtgtctttcattgcatgtgttaaattaggccttgacgggaggaatgcgtcaatattctttccactatggagaacacaggataacacagattgtctgtgttggtaaccaatgatctgaaattctctccgtgtcactctgtattctctgtggtgagttctgactttacctctgttaagctgtgagtggatttattccgtgcgtttacaggagtttgcctgtaagaattcgttcaatgcatcttcataattgccttgtagcaaaatgtgatggtttccgagtggattcttcaggaaataatcagccggtgcattcatttttatacgtacttgtgtacggcacatattgatgtaattggtgttttcggtcagagttccggtagaaaggtaatattcgtccagacattctccaccacatttcacgatagtgacatctccggtcggcagcagtccctgaataccaataccgctttccgtttcaaaatggctacggatgatataacgttcggtttgtttcattccgatcgtgcaatgtgccagtattatttcgttgttccgggcgttaatcatcgaggggtttgccatgaagcccactttcccggtcagtgctttagcagcgagtaatgtaaatacagattgcaaatctccttcacatccggcaatgatcccttcgtcgttcagcatggcaagagccaggcaaccggtagtaccggtgcgttctatcagtttgaaacaactcagggttacggcacttagtttttcttctttacaaattcgcttgacggcccggtaaaggcgcattgctttaatcatatcttcgggagttccttcgcggcatgccaaggcttgagaagcaactgcggcgcatgaggcaccgacttcattgtctgtaatacgatcgtatacgtcataaattcgttccaacgggatgtccagatactcaattccccaacgccgctttgcgagcagataatccacgttgcttgcgatcagccacgaggaaggagcaccgatcactccgatgcgaaggcctgctaatgaacgttgtgctttgaaattggtataaagtacctgaattcgttgaacgatactcataaagtccccatggaggatttcactcttcatacctcggccacgtaaccaagaggagatttccagtgccgcagccagggagttttgcattccgtctgccagtataatggcaggccggggaagcgattcgaagcattgcattaccagcctttcgacccctccggtagcaatgaaaatgatactgaattcatcttttggcaatcggtcgatgtcccggtaatccatgaacttcacggtgaaatatttttccagttcactgagaatcgcttcgtgtgaactacgtacagtggcttgcttatgcagaatcgatgcaaatgtgatcaggtttatggtcattatgttatcgttttaggtttgtagttatacaaatgtatcgttttctgttgatattaccacaacgtttttacccttgataaggtttttaaagtttttatgtctttgtgtccgatttattgtgtacatttgccgctcatatttattaattgaccatttataattcaagattatgccaaccatatcgattcgcggaacagagatgcctgcatctcctatcagaaagctggctcccttggcagatgctgccaaacagcggggaatccatgtatttcacctgaacatcggacagccagacctgcccactcctcaggccgcgattgacgcgatacgcaacatcgaccgcaaggtgcttgaatatagccccagtgccggttatcgtagctatcgcgagaaattagtaggatattacgagaaattcaatatcaacctgacagcagatgatataattattactaccggaggttccgaagccgtgcttttctcattcatgtcgtgtcttaatccgggagacgagatcattgttcccgaaccagcttacgccaactatatggcttttgccatttcggccggagctaaaatacgcaccattgctacgacaatcgaagaaggtttctcgcttccgaaagtagagaaatttgaagagttgatcaacgaacgtactaagggtatcttgatctgcaatccgaataatccgactggctatctgtatacccgacgtgagatgaatcagatccgtgacctggtgaagaagtatgatcttttccttttctccgatgaagtgtaccgtgagtttatctataccggttccccttatatttcggcttgccatctggaaggaattgaaaataacgtagtgctgattgactctgtttccaagcgttattcggaatgtggtatccgcatcggtgccttgataaccaagaataaagaagtgcgtgatgcagtgatgaagttctgtcaggcacgtttgagtcctccgctgatcggacagattgctgccgaagcttcactggatgctcccgaagagtactcacgcgaaacttatgacgaatacgttgagcgccgtaaatgtttgattgacggtctgaaccgtataccgggtgtttattcccccattccgatgggagctttctatacagtagccaagttacctgtcgatgattcggataaattctgtgcctggtgtctctctgagtttgagtatgaaggacagacagtgtttatggctccggcttccggtttctatactactccgggctccggaaagaatgaagtccgtattgcttacgtattgaaaaaggaagatttaacccgtgcgctctttgttctgcaaaaagcattggaggcttatccgggaagaacagaataagacctgatgtcatccattcattcacatagtcaaagcaactccgttcccttttccaaagagaagggcaaggtgaggctttcctattttcttgcccgtcggatttatcgtgatacggacggggggaaacaagtttctcgtcctgctgtcctgattgccatgattggcattgctatcggcctggcggtgatgatcattgccgtatctgtagtgattggttttaagagtgaggtacgtaataaagtgatcggcttcggctcccatatccagatcagtaattttgatgcggtagggtcctacgaaactcatccggttgtggtggatgatagtatgatgatcgctctttccgcccgtccggaagtgaaacatgtacagcgatattccaccaaaccggggatgataaagacagatgacgcttttcagggcatggtgctcaaaggtgtcggtccggagtttgatcctgcctttttccgcgaccatctggtagaaggagagataccggtcttcagtgatacggcttccaccaatcaggtggtcatatcgaaagcgatagctgaccggctgaaactgaaactgggagataaaatatatgcctattttatccagaaagatgtgcgtgcccgccggttgacggtgaaaggtatttaccaaacgaacttttctgaatatgataatctctttctgctgactgacttgtatttggtgaaccgtttgaataactgggctcccggacaagtgagcggagcagagttgcaggtacgtgactatgacaaactggaagatataacctatggtatagccgttgatacggacaataagcaagatgtttacggggggacttattacgtacagagcatcgaacaaatgaatcctcagatatttgcctggctcgatctgctcgacctgaatgtatgggtcattcttatcctgatgattggggtagccggcttcacgatgatttccggattattgattatcatccttgaacgcacacagatgattggcatcctgaaggctttgggagccaatgatttcactatccgtaaagtatttctgtggttctctgtctttctgattgggaaagggatgttgtggggaaatgcaattggtattactttctgtgttttgcagtcacagttgggactttttaaactcgatcccgaaacttactatgtaagtatggtgccggtttccatgaacatctggcttttccttctgatcaatgccggcaccttattggcttctgtattaatgttggtcggtccctcttatttgataaccaagatcaatccggccagttctatgcggtacgagtagtcaagttatcttcgcataaaatcaccctttctgcgatagagacggtagagtctgaacttcagggattgtagcggacggatgatgtcgaaaaccggtagtgtaaagtagtaagagcggttgtctcccatctcattggctgttttgttgatgacgtaggcttgcgccgaataacgtacgatccataacaataaagccagtcccgcagccagccagtgaaaagagaggataccgaatacgattcccgacaggcagacgacataaaacaatagcctcgtggcggtttccaatcccagtaaccagcgttgtgaacctttatagaagcgtgcggttgccatgtagcttaccttttcttctttccagtccttatagcgttccacaggttgcatccgtatcactgaatccggtgaggtttccacccgggtattgttttcattggcaatttggttgataaacaggtcatcttctccccgctgcatgttcaagtgggtagaaaatcctttgactttgaagaacaattccttgcggtaggccaggttgcgcccgatgcccatgtacggtttacccgccaaggcaaaacccagataacgaagcgaggtgaaaagcgagtcgaaagacacccgtttgtgcagccatccttttccccgttcgtaaccgctatatcccagtacgatgtctgtactcggcgtgaaattgcgtgctatccgtcgaagccacttgtcactgaccggagtgcagtcggcctcggtgaataccagccagtcatatttactggctttaatgcccagcgtcagtgccagtttcttccggctgatgtaccgcgcgctgtccggtgtgaaactgtgatacaggttcgggtattcttcttccagctctgacaggagatcttcgctttcgtccgtagaaccatcgttgatgacgattacttcaaagtccggataatcctgtttcaggatagcgggcaggtttcggcgcaggttttccgattcgttgcgtgcacagatgactacagacagcgggggaagttctcgtccgaagtgtacttcatcttttccaacagcaaggttgtgggtgtgtatccggttatacagtccgagatagtagataagttgaacgatcaaaagaacgcctgcggctgatagcagtatcagttcggccgtattgaatgtgaatgcttccattgaatcttacaagatgtttaagtcgcaaaagtacataatttttcagagattaggtgatttgtttctttcttatttcttattgtccagatattcctttttgaacatatcgacaaataacaagaacagcgataatataagcggtccgaagatgactcccatgaatccgaacaacggtaatccgatgactacaccgaagattgtaataagcggatgggtgtctgccattttcttctgtaagataaagcgtatcaggttgtcacattgcgaaacgacaattcctccgtaagctgccagtccgatggcatttgcccattcaccggtcagtgcaaggtaggcagccaccggaaaccagacgagagcagtccccaccatcgggatgattgtagcaaaacaagtcagaacacccactaaccaggcattcggtgctccgaagataaagtagccgatcagtgcgactcctccctgaataacggcaagtaagggaataccgatggcattggagcggacaatcatgttgatattgtgtgttacctcccgggtgtttttctcattgaaaggtaggatatcgtcaatgtaggactccattttggttcctcctatcagcatgaaataaagtacaaagaccagaacaaacagattgattgcaaagctgctgatacctcccatgactgcctgtcctattttggggagcaaagaaacgatgaacgaaagtgtgtcactgcccagcacatcatatcctgttttcgctttgatgatccctgccagttcttcaacaggggcaataatggcctgtgggtccagattgatgtcctgcaacttgttgaccagcatccatacaatcagagaaataggtaccaggaagcacaggatggcttcacctgtaatcagcagggctgcgaaacttcgtttcattcgtgcaccgagatacatcatttgtcgtcggaccaggatatagatggtgagtgctcccaataatccgccgaggaaaggggtaatttgccggaacaagatgatgcccagcccgatgatgatgataatcaaagaatatttccaatatttttctttcataataaataaaaaggagagtagagattcctctctatttataacattacacctactaaaatgtttcagtcctgaggcaggtcgatactgaaaattgtttgtcccggacgacttttacggatcgataagtgtccgttgtgttgtcggatgatctgcttgcagagactgagtcctattccgcttccctccgtttttgtggtaaagaaaggaatgaagatctgctcacgtatctcttccgggatgccgggaccattgtcttctatttctatcagcagacggtctgtctgttgcaggcggaggatgattctgccttccgtctgtccttcgagagcctgcatcgcattcttcagtaagttgaggaatacttgtgacagctggtttgcgtcgccgtcggtttctatcgaatccggtgtggattgtaacacgaagtgaatgccacgttcgcggaaatcactttgcaacagttcttccaggttatgcaacatatcggtcagtgagaaacgtttcttttccgggtgagggaggtaggacagatgccggaatgattccgtgaattccatcagccgttcgctttgtgtttggataatccgtagtccgcgggctgacttttcgttgatatccggatatgcggataaggtttgtgagagtgaaataatcggtgcaatcgtgttcatgatttcatgggtcagcacatgtgtcagtttgctccacgattcactctccttatcactcagctcgtcaccgatatctttgatggataagatggttatggtttcaccttccaggatcatctcttttcgggatatgctgaggctgtcgcgaatgccggttgcattcagcagttgtgccagttgcatttcggtgtaaagacggttgcacttcagcagagagaaggcagcactgttggcagtgatgattcggcctgaagcatcccaggcaagcacgccgctgggcacttcttcaagtaacgaccggtagaagtgctcctgtttctggttttcgcctttggtacgggcaagcaggtcgttgagccggttgaacgaacggttcagttgttcctgttctttgctgacattcacttccgggaagtagagcatattgtctttatcctgcactgcatcgaagaacaatttgatttttcggttgaatgtatttagccgccgggtcagtgcaccgatctgaaaaagagaacatagcaacaatatactgccgatgatgtatccggtgctggataagatcagccatagtccggcacccgccgtagcgagtatcagtacgatgtggagcagtataatgaaatagatgcgtcggctgaatatcatcggggtcagagtttgaatcgtttgagcttgttatacaacgtttgccggctcacgcccagttgctcggcagcggcagtcaggttaccgttgttttgcaggatggcagtttcgatggcctgccgttccacctcttccagattgggtacggtgactgctgcctgtggctgccaggtctgtttcaccaagatatctttgggacggatcacgctgccctcacacaagatgactgctttctcgatggtatgctgcaactcccggatattgcccggccagtgatacccgcgcagtttttcaacagtctgttcgtgcatccgtatttcctgacgttgatatttggaagcgaatttacgtaagaaaccgtcgataaagagcaaaatgtcgtctcctcgctcacgcaaaggaggcagttccagatggatggtgttgatgcggtagaacaagtcttcacgaaacatcccttcttttaccattgcgggtatgtccttgtttgttgccgaaatcaggcggatatctaccgggatcactttgttgcttcccaaccgcatcacattgcggctttggagtaccgtgagcaacttggcttggagcgacaggggcaggttgcctatttcgtccataaacagtgaacttccgtcggcggcctcaaactttccccggcggctttcgtaagcatcggtgaaagccccccgttcgtgcccgaacagttcactctcgaacagtgattcgctgatcgctcccatgtctacgttcagcatcgggcgtgcaccgcgaggtgaaaggcggtgaatctcccgtgccaatatctctttaccggttccgttttctcctgttatcaggatgttggcatctgtccgtgccactttagatactactttcatcagttgcagcatggcaggcgaatgtccaaccagcatttcgaacccttcttttttgttttcctttgtctgccgttccgaaggtttcctgttgttgcggtaggcttccgtcactttatcgatcagggcctgattatcccatggtttcaggaggaagtcggcggctccgtttttgagtgcttttacggcaagttccacgtctccgtaagcagtcagcatcactacgggcagggtaggggccatcttccggatatgtcccagccaatacagcccttcgttgccattattgatgcctgccgagaagttcatatccaggatgaccacgtcgatgcggtggttcgtcagcagggcagtgatctgattcgggttcgaagccgtcagtatcttgcagaagtagttttcaagcaaaagttcgagtgaagccaacacccctttgttatcgtctacaatcagaatagttcccgtgttcatgatatctccttttgattcgcttcctgtttttaagttcgtggtaaagatatttgtttttgtaactccctgcaagagagtgtccaataattagacgttttcgaattgagaatttatatgggaaggggatgtggggacaaatccggggcatgttgacatcaaccgtccaatatctgtacgcagtagcgtccaaatattggacggtatctttttattgataaatctatgtggctgaattttagttgtttattccttttggcacactctttgctcagatggtttatatgaaacatcttatatcactttgtaccttatttcttttttccgctcttttgtctgcacagacagagagatcgctcgacgaatgtattcgtatcgcatggaaacagaatccgtctttgcggaatagcgagatagatatcaaggaaaaccggatgaactatatctctgccgtggggagtttccttccccgcgtcagtgtatcggccgaagccggacgaaacttcggacattccatcgatccgagcaccaacggatacaccaataatacgttcgatgaaggaaccgtggggctggacatgacgctttctcttttcgaaggttttacccgcatcaaccgggtacgttttgagaagatgaaccgcagccggagtgaatgggctttgaaggaacggcgcaacgaacttgcctgccgggtgacggatgcctattataaactcctgcttgaagagcggatgcttgatctggcttttgagcagagccggctaagcgaacgttatctcaaacaaaccgaagcttttgtagaactgggtttgaagtcggtttccgacttgcaggaagtcaaagcccgtcgcgagggtgatatttaccgttaccaggtgcgtgagaacggttgtcgcctggcattgctccaactgaaacaattgttgaacctgcatgccggggatacattggtacttcaggatacaatcaattacgaatctcttccgccttgttcgctgccccagacagatgagctctatatgcaatctctggtagcaatgccttcgatgcggatgatggaactcaggcagcgggccgcccgtaaagagtatgccatggcgggcggtaagttttcgccgacggtttttgcccgtttctcaatggcctcccgttatctcgacggtttttctaccaaacagctgaacgacaatttaggaaagtatatcggtgtcggcatttccatccctttattgagcgggttggaacgactgaccaccctgcgcaaacacaagttgaatatattccgtctccggaatgaggaagaacttcaaaaacaacaactctatacagaggtggaggaaacggttctttctctccgttccggatatgatgaattccggcaggtattgcagcagttcagggccgaagaactggtactgaaagaatccgaacgaaaatgggaagaggggcttatctccgtattccagctgatggaagcccgcaatcgctttatctctgccaaggccgagttgacccgggtgcgcttacaggtggatatgacccggaagatggaaacttattatcggacgggaagcttttgtacgttgcccggtgagaagtgatatacggggtatgtgaccggtacaccgttcctttacgacctgacgggataatcttataaacaaacgtgaatcatacataaaacaataactatctatggatacaatgatcgaacggaagcccggaatgaagcgaaaacattattatgctattgccggagccgtggcactggtgggacttatcttttattttattttcagggacacttcctcttctatgagtgtagaaaaagaccggctgaccatcgctactgttacccgcggagagttcagtgattacatccgggtcatcggacaagtgatgcccaaccgcatcatttatatggatgcggtagagggaggccgtgtcgaggagcgcctgaaagaagagggggccatcgtcaaagcaggtgacgtcattctccgtctcagcaatccgctcctgaacatcgggatcatgcaaagcgaagccgatctcgcctaccaggaaaacgagttgcgtaacacccgcatcagtatggaacaggagcgcttgcagctgaagcaggagcgcatcgggctgagtaaggaactggctgtgaagcagcgtcgttacgaccagtacagccgccttatcaaagagcaattgatagcacaggaggatttccgactggcacgtgaagagtatgaggcggcacaggcacaactggatgttgtggacgaacgtatccgccaggacaatattttcagggagagccagatccatagtctcgatgaaaacattcgtaatatgaagcgcagtcttgccctggtacgtgaacgggtggaaaacctgaaagtaaaagctcccatagacggacaggtggggaacctcgatgctcagatcggccagtccattgctgccggcgagcatatcggacagatcattacgcccgatctgaaagtgcaggcacagattgatgagcattatgtagaacgggtgattcccggacttccggctgattttacccgtgacggaggaaactataaacttgaggtgaccaaaccctatcccgaggtaaaggagggccagttccgcaccgaccttcaatttacttccggacgtcccgagaacatccgtgccggacagacttatcacatcaatctccagttgggagatcctgcccaggccattcttgttcctcgtggcggattctttcaaataaccgggggccgctggatgtatgttgttgacgaaagtggtaaatttgccacgcgccgtcccatccggatcggacggcagaacccgcaatattatgaagtgactgagggattgaaaccgggcgaccgggtgattgtatccggatatgaattgtttggggataacgagaaacttatattgaaataagaaccgaatactatgaactacatttcgcaagtgatacgaagccagcgggttaaaaagtctctgacgctgataaacataacagggttgtcggtctgcattgcggcggcacttcttattatgctttatgtctggtcggagttaagttatgattcatttcatgataccgaccgtgtgtatcgtgttgaaagcaggctgtatgaaggcgagatgctgacggataactgggcgactacggcttatgggcatgctcctgccatgaacagggaaatagcgggaattgagaagtacgtccgtgttacggctcaggatcgcgagcaggtggtgaattacttcgacaggagatttgccgaggaacattactgctataccgagcctgcctttttcgaaatattcaacttccccatagttaaaggagaaaagaccgggcaactggtacgccctaatacggtggtactgactgaaagcgctgcaagccgctattttggtgaagaagacccgataggcaagatactgaccttcagtacctcttcatcacagcaaaactttgaagtaacgggcgttattgccgatatgcctgtccgttcgcacctgcgctacgatttcctgctttcctacaatacgattcccaaggaacggcaggacatctggtacattcacggtgtatatacttacgtccgcctgatgcccggaaagactcagggagaaattgaacaggctttccgtgacatatccgacaagtacaagactgatgcactgaaacataaaacctgggctgtagaactgatcccgttgaaagacattcaccttactccgcaaaaagcatacgagaaagaggtgaaaggaagccggacggcggttcttattttgttcgtaatgtccgccattctgctgctgataggttgggcaaatgccttgaacctgaccgtagcccgctttttggagcgtggacgggagttcgggctccgtaaagcttttggtgcttcgcgccgtcagattattatccagggacttcttgagtccggtttcatgaacttgctggctacgttgatagctttcggctggttggaactcctcttgcctcttgtctatcgctgggcagggcaaagcttcgggacagacatacttatgcaacccgctttctgggggattgtagccggagtggttatcatcggtacgttggttgtagggctttatccttcctggctgatggtcactatccgtccgtcggagattatgcgcggtaaactgttgcacggaaagagaggcaaccggatcagaaaggcgttgattgttgttcagttcctggcttcttttgttctgattgcaggcacgtttactgtgtttcaacaggtccgttacatgcagcgtgaggccgaatcggatctgaatacccgcattttggtcattaaatatccttcgttcaccgagggactgtcgctgcgcatggagagcttcaccaaacgtttgaagcaacgggcggatgtaagtcacgtgacagtctcgggagctgttcccggtgtggaagttgccaactattttaccaatcggccgtatggaagcgatccctcacaagtaaaattgatacagatgttttctgtcgattacgactatttgtctgcttatatgccccgtatggtttgcggacgaagtttttccgaagattatggtggcgatcttaaccgggtggtgcttaacgaagaagctgtcaggctgttaggctacgaatcggcagaagcggcgttggggcaacaacttaaaatggaagtggttagtgacccgcttgagataataggagtggtggagaactaccaccagcaatcgcttgccgtggcttacaagcctatcattttctttttgaaagagcgtgttccttttattgcaacgccttatatttctgtctgtctgaaaggaaagggggatgccggcgtcttgacggaaattgaacagatgtatcgtgaatacttcccgacttctttattttcttatttctttttgaatgattttaatgaattcctatacaaatccgatcgtaattttggctggatatttgccagtgcctcattgcttgctgtatttgttgcttgccttggattgtggattgtaacactgttttccaccttgtcacgtttgaaggaggtgggtatccgcaaagtgctcggcgcaaataaaaccagcctgttctttgttctgaccaaagaactgttgttgcttaccgtattggcatctgcaatcggtattcctgtatcggcagtgctgatgaatgcttggttggaaacgtacgctttccacatttcgctgtcctggtggatatatgcagccacttttgtactgctgatgctgatagcctttctcactgtgttccaacaggtatggcgtaccatccgccagaaacctatgcgcattttaaaatatgaataactaatataatatataacgattatgattaaaacagaaaaactgtctatgctcttcaccaccgaggaggtgcagaccaaagcgttgaatgaagtgaccatgcaagtggagcggggagaatttgtagctatcatgggtccttccgggtgtggcaagtctactctgctgaatatcctgggtacactcgattcacccacttccggctcttacttcttcgaaggcaaacaggtggacaagatgaacgagaatcaactgacggccctgcgtaagggaaatctgggatttattttccagagtttcaacctgattgacgaactgaccgtatacgagaatgtggagcttcctctggtatatctgggcatgaaacctgccgtacgaaaagaaaaggtgaaacaggtacttgagaaggtaaacttgttgcaccgtgccaatcattttccgcaacaactttccggtggacaacaacagcgcgtcgccatagcccgtgccgtggtgacggactgtaaattgttgcttgccgatgaaccgaccggaaacctcgactcggtaaacggtgtggaagtgatggagctactacgggaactgaaccgtcaggggactaccatcatcatcgttactcactcgcagcgtgatgcgacttatgcccaccggattatccgcctactcgatgggaagatcgtagccgagaatatcaaccgtccgctggccgaaacttccgggactaatacagagagcgtatgatagggaattattggaatagtgcctatcgtaacctgatgaaacggaagggattcagtttcatcaatgttttcggattggcagtcggcatggcatctgccttgctgatattgacttatgtcacttttgagttcagtttcgacaagatgcacgagaagtacgaacgcattttccgtgtggaaagcactttctatgaaggcgaagtacagaccgactattgggccagcagttcgtttggttatggttcggccatgaaagagaatctggccggaattgaagactatacgcgggtggtctccttgtaccagccggaacagattgtgaagtatggtgaacttactttacgtgaaaaccagattgcttatgccgatcccggcttcttccgtttgttcgactttgagttggtgaaaggagataaggccacttgcctctccatgccccggcaggtggtcatcaccgaacggattgcccgtaaatattttcaggatgaagatccaatcggtaagatacttatctttactggaccttatgacaaggtggtttgcgaagtgaccggtgttatgaaagagatgccttccaattcacatgtccattacaatttcctgatttcctataaatcgctcggacagtatttgcatgattattggtataagcacgaggtctatacttacgtattactcgattctcccgaaaggaaggcagaaatagaagaagcgtttccggcaatggcggagaaatataagacggacgaggctttgaagaacaaaatctggggcgtttcactgactccattggccgatatccatctcaaaccccaagtgggatacgaggccgagatcaagggaaaccgcacggcgatgattgccctgatttttgctgccatagccattctggcaattgcctggatcaattatatcaacctgaccgtagcccgttcgatggaacgtgccaaggaagtaggggtacgccgggtgataggagctttccgcaaacagcttatttcacagttcttgtttgaggctttggtgatgaacctggttgcttttgtgctggctgtggggctgattgaactggttctcccgtatttcaatcagttggtaagccgtacggttaccttctctgtctggctgaccggatattggtggttgttactgttgttcgtgttagttggcggcattttcctttccggttattatcctgcgctggcactgctgaatcgtaaaccgattacgttgctgaagggaaagttcctcaacagtaagtcgggagaaggcactcgcaaagtgctcgtggttgttcagtatacagcttccatgattctgctgtgcggtacattgattgtgtttgcgcagttgaacttcatgcgcagtcagtcgttgggagtgaagacggaccagaccctggtggtgaaattccccggacggaccgaagggatgaataccaaactcgaagccatgaagaaagctattgcccgtctgcctttggtggataaggtcactttttctggtgcggttccgggtgaggaggtggctactttcttatccaatcgccggaaaagcgacgctttgaagcaaaaccggctctatgaaatgctggtgtgtgacccggactacatcgatgcttacggacttcagcttgtggctggacgcgggttctctgaggattatggagacgacgtgaataagttggtggtcaacgagtctgctgtccgtaacttaggatttgcttctaacgaagaggctctcggcgaagagatagaggtggagtgtaccgatgctccgatgcagatcatcggcgtggtgaaggattatcaccagcaggcactcaataaaaaatatacgccgattatgttgattcataaagataaaatcgactggttgccgcaacggtatatctctgttgtgatgaagtccggcgacccgaaggagctggtgtcacaggttgaggagatctggcatcgctatttcgaagattccagttacgacttcttcttcctcgaccagttcttcgatcatcagtatcggcaggatgaggtgttcggtgtcatgatcggctgttttacaggtctggctattttcatttcttgtttgggattgtgggtactggtaatgttttcgtgctcgacgcgtaccaaggagatgggaatccggaaagtattgggggctacccgttggaatctgttctatcaactgggtaaaggcttcttccaattaattctggtagcagtagtcattgcgctgcccgtcgcctggttcagcatgaatgcctggttgagtcattatgctttccgcacggacctgaaagcatggttctttataattccggtagtgttgatgctgctgatttcgtttgtgacagtagcctgccagacagtgaagattatagtggggaaaccggcacgttcattacgatatgagtaacctgacgcaatagatacgaatacgattcaccacagagtacacggagtacacagagattaaaaactctatgctctctgtgtactctgtagtgaattaaaagtcattgcaaaatcagttggttttatttctccgattcctgagcggagcgataattcctttattgctgtgtatggttctcttcaccccaatgagttttcgcttccagttcttcacggtcacgcacctcttttgctttttttgcataaacaatcattcgcagagactggtcgtaagtgaagtaattccatacccagttaagcaatacgtttgctttgtttcggactcccaggatggaacgtaagtgaacaaccagccacatcacccaagccagccatccggcggttttgaaactactgaactctgctacggcacggttgcgtcctacggttgccatcgatcccaggttgcggtaatggaacggttgcatcggttttcctttttccagtctttgcaggtttttggcaagcagctctccttgttggatggctacttgtgccagttgcgggtgtccgttgggatagttcttgtccgtggtctggatacactggtcgccgattgcgaaaatatgctcagttccctgtacacggttaaattcgtctaccttgattcttcttccccgtcccagtaactctccgctgatattgccaaaggtgatggctgccacaccactcacccagatgaaggtgcgtgtcgctatctctgtaccgtcttccaacaccactttatgatctttgtagtccgtcacccgcttgttcagcaggatattgactcccatctcacgtaggaactgttcggcatgacgcgatgaatcttcggacattccggccaacagtctgtctcccgcttcaatcagatagacgtgcatcaggctgctgggcatatccggataatcattggggagtacgaactttttcatttccgaaagtactccggctatctccactcccgtggctcccccgcccactacgacaacattaagcaactcctgtcgctcacgttctgtggcgcaggtgattgaccgttcaaagtttgccagcagagcatttctcaatcccatggcttccgaaacggttttcataggcatggcttcttcttcgatgtgctcgttgccgaagaagttcgaagtagtgccggctgccaataccaggtaatcatattctgctttaccgatggaagtctggatcatctttttctcggggaaaatggcccgtacctctgccatgcggaagtaaaagtcttttcgcttctgaaaaatcttccggaaagggaaggagatagagctgggttcaagtccggcggatgcgacctgataaatcaggggaggaaactgatgataattgttcttgtctactaaaacaacctgaaagccagatttctttagcttgttggccaacttgagaccaccgaagccaccacctacgatgatgacacgcttcttgtcgttttttacaatgttgaaactcatactgaaaacttctatttaacctgatgtgtctaaaaactaatgtcatggaataaacatttatcatcggtataaagtttccgtaaacagcaattaaaatacacagattaagagattacacaaagatataacagccggggttgcttatccgtgaattgtctgtttgtgtaatccgttaatctgtggtgaaagagattttgcaatcgtgtaccgtggcatttataattccggtactgtcctgaatttagtttccgggaaatgcttcttcagataccgttggataaatagctgtgtatcctcctgtatagtccggtcttcgactgtgggatagaggttgtataacaccgtatccagttcgatgccccggcttttgatagcttccagactgaggagagtatggttgatgctgcctaacttgcccgaagtgacaaaaagcaacggataacccttttgcgctacatagtcgatggtcaggaactcttcggtgagtggaaccatcagtccgccggcaccttcgagcaggacgatgtcgtaacggtggctcaactcttctgtggcacgttctatcttgtcgaaatcgataggccgtccgtcaatacgtgaggcgagatgtggggaacaaggataagaaaagatttcaggcatggtcaatccttcccggtcgtcatcggtaagggcaatgttcatgatgcggcggtgcaggtcgatatcttccgaatgaccggtatttccggtctggataaacttttgggtaatggtacgttggcctttccggttcaattcccgtgccagataacctgtggcataactcttgcctgcatctgtgtcgatgccgctgataaaatacacattctttttcatacttcttatgtttgagacccgcaggtcgttattatctctttttcgcaatgatataaatgggatgataggtcagtgaaacagagcctttaccggggctgaacagacgctcatattcctgacagaagaggttcagtttgctccgggtccaggcgctgttacaggtacccgtcactccggtttgtttcaggtgataaagtacttccatcggattgctgaaattcagtgagatgatttcttcttccgtatgtacgatgtcgtatagtgccgagagcgaagcagtcagttcttctctcgaacggtaggcgagtccctgtccggtcagttgacggatctctttcatgttttctttcccgaatgtactgaaagcgatgtatccctttgcattcaagatgttttcgcatttgcggaaaaaagcgtcgggatgctcaaaccattgcaggacggaacacgaggtgattagttccgttccgtggggaaaagcaagtgcttcggcatctccgggcaggaaagaaacctgttcgttcaggatatcttcgcaactgtggcgcatctcttcacagagatcattcagtagtaagcattccggacgaaacgaacggagcaacaaacgcgagtaagtacccgtgccacaaccgaactctacgatgcggcggaaagattgccgggggaggtgctgctgtaacagggtacacattttccgggcaatctgctgttgcacgcgggcttcgtgaggataggtatcgattgctttcgagaagcgttgagcgatcagttgtttggaaaagggaataatgggagagaggttctctttcaatatcttatcgtcataatgtgctccttcatatcgttgtatttcagtacaatgcccttcccacgcctgttcctgattccgggacggaaagatatggtctgattctccgataatcgctttattccagacaaaggcggatgggggcagttcgttgcattgcttgcggatggcggccagttcctctttcagttcctcaaccgttctttggggagctatctcgcagaaagccttaaagtcacttcccgaaccgcacatccgccggcgaaacttctgtagcgttgcttcgctgaggttgctgagtgtgccctcaaaaatgacgggggggattcctcttgcgtcatcgatggggaaaggggtaccgttgatggcaatgctttgcgttatggggaggttactgccttgcagcacttgtgaagcagcccatactcccattgaccaggctacaacctgtatttgggtatatgtggagagcaacgtcttgtcaaagtcaagggaacggtaatcatagcagataatcaagtctctatgttgcgggagataatgtatgaagggagtttcgtccattccccatccggtaaagaagagaatgacttcactcccggtctctctcccggggagaggagagttctgagaatattttgattgatatagtcttttaagtatcatagctttattgtttatcgttcacagtttatcattcatcgtttacagttcatcgattatcatttactattgatatgagtttttcgacttcctcatccgtcacgtctgcggtcagtgaaaagcggatgcgggaagtaccttctggtactgtaggcggacgtacaggtaatgcgtagaatcctttgcgttgtaattctttcgctatctgtaaggcagttgcgctttcacccgctaccataggcacgatctgactgactgaagcggaagaataacctttctcccgaagcgcagcccgcaaacggttgccgatggccgctaagtgttccctctttgcctgatatccggccaaatggcggagtacgaatgaagtccattgcagggtgacgggcggaaggccggtggtgaagatgaaaggacgcattttgttaatcagataatcccgtattacttgcctgcacacgatatatgccccagaggaagccagcgctttcccgaaagtacctaccagaaagtcgatatccgctatgcatccgtaagcttcggcacatcccagtccatcggtcccccgaaccccgacagcatgggcttcgtccacgtagagcagtatgttcgggtacttttgtttgagcttgaccagccggggcaggtctgcttcgtctccatccatactgaagatgctttcggtaacgattatcacctgttcgtattgtttgtggtgggtttcaactaacctttccaattggctgtattcattgtgccggtagcggatacatttggcctccgatagccggataccgtctatcaggctggcatgtaccagtttgtccgcaagaatcagtgtctttgtgttgcatacggccggcagaatacctgtattggcatgatatccgcagttgaataccaatgctgcttctgttccgaaaagtgaagacaagagatcttccagttcaccgtatgcggcaaaattacccgtaagcagacgggaggaagaggaagagaatttgacttcttccggtttcactgtctgccagaaagcatttagtaagacagtatcattggccagtcccaagtaatcgttggacgataggtttagcatccgttgcccgttaatgatgacctctttgccttgatgaatcagggtagggaggatacgcaaattattctgttctttgagaagtttcaactcctcaaagaaacggacggattcatagccttccgtttcttgattatagttcatgattgtaatggttttgagtattattcaccacagaggacacagagaacacagagttttaatctcttgtttattaggacatttaagagaaatatatcctctgtgttctctgtgtcctctgtggtgagttatattcatttctgatcagtttagagacaggtggagccgtcggttatacattctatcattccttccgtcagtttcgtcaactgttcggatgtaatgataaacgggggcattacatataccagtttaccaaacggacgcagccagatcccttcttctacaaaacggcgttggaggtgtgccatgttcaccggttctttcatttcgatcactccgatggcacccaatacccgtacgtccgccacttgaggaagattacgtgccggagccagttcacggtttagttgcgcttcgatccgttttacgttttcttgccagccggattccagaagcagccgtaccgatgcacacgccacggcacatgccaacgggtttcccataaacgtaggcccgtgcatgaaggcacccgggaagtggttggagatgcagtctgccacttcgttggtggtgagtactgccgacagggtcatatacccgcctgtcagtgctttgccgatgcacatgatgtccggctctactccggcatgttcccaggcgaagaattttccggtacgcccgaatccggtcgctatttcgtcaaagatcaacaataccccatgctgccggcagaggcgtgcggcttgccgcaggtattccggatgatagaatcgcatgcctcccgcaccttgtacaattggctcgagaatgaaagccgccagttttccggactgcttttccagcagttgttccagcggacggatgtcttccggatcccattcgtctccgaaccgtgaagtgggggcggggaggaaatggcggatggggagtgccgaaccgaaaatactgtgcattcccgttaccggatcgcataccgacatggcattccaggtatctccgtggtaaccgttgcggatggtgacgaaattacttttttccggttgtccggctgcataccaatactgtacggccattttcatcgctacttcaactgctaccgaacctgaatcggcatagaatatcttttgcatggaaggcggaaccagcggcagcaacagtttgcccagttcgatagccggatcgtgcgtaagtccgccgaacatgacgtgagacatcttgctgagttgctcttgtacagcccggttcaataccggatgattgtatccgtggaccgcacaccaccacgatgacataccttcgatcagcgtctgcccgcttgctaatgtgatggtgacgccgtcagcccgtttcactttatagaccggaagtggattggaagtcgaagtatacgggtgccataagtgttcgcggtcgaactgtgagtcggcaaaatggtagccttccgagagaatcatctctttgtcatccgatactttagagccaagagtagtcagcaaatctcccacaatggcggagttaatgccgatatagagcgatttccggacagcttcgggcgtgagctgcgaacgtcccccggcaaagcgcaggtaggctgtagggttgatgaaacggaaaagggcgattgttgtcagtacctcttcttcgctgagcggtgactgatgttcgagcggagtgcccggtatgggttgcagcaggttgatcgggatggattggatgtcgagctcgcggagcgtgaaggcaaactcgatccgttgttccacggtttcgcccataccgatgatacctccgcagcaaaggtccattcccgcccgtcgcgcggcatgaagggtcttcagtttctgctcctgtgtatgtgtggtgcagagtgagtcgaaatgtgaaggagcagtctcaaggttacagtgataccgggtgactccggcattgtagagtgcctgtaattcttcttcgtccaatagtcccagtgaggcgcatagccggatagacgagtgacgtcgcatccgtcgtgcggccgcgcaaagttccttcatgtttccgggtgaaggtttccgaccgctggtcaccagtgaaaaacgattgactccttgcgcctcgttgtatttggcttgacgcagacactcttccgcactcaccagatcatatacatctgccttcgtcttgtagtgggatgactgtgcgcaccatttgcagttttcggggcagcgtcccgaacgggcattgatgatggaacacatgtcgaactcctgtgcagcgcagaaacgggtgatttcgtgcgctgcgtcgtacaactcttcttttcggggaaattgtgccagccattcggcctgctcacggctgatgaccgttccctgtaatacttggtttttgatttcttcaatggtcataggatggggaattaaaaaagaggttgccggtcccatttggatgggaggcaacctctttatatgaaatgtataaaacggatgtcgcaacagcctgctgcgcggcacctgaataagaatatttcaaagattgaaatggaatgaacagaaagagtaagggtgtgggagacagtacggtactctcccaatcttcttccgggacagaatcttctgtttcacgttgcggatcaattccttccgtatgtggagtctgttgcttgcacaacgcacattccgtgacattctttctcaattgtccgatggtgacacacaatcccaaagtggcgaatatggcataggctttccggctccactggcggaagcggatgaacgaatgcgatatatacctttcttttttcataagctatatggggaatatcatgttatcggacgggggcaaagctacaaagaatctacggaatgaccaagggaatagcatcggtttgtaaacagaagtgtcacttctaccacaaatgcggtacaagaatcccctataaaagggatttcgggaacaacccctatactctacttttgcagcaggaaatgatccgtgaaaattaattaaaaaatgtaggtggcttttgacacaccttcaagaataagataacaatttcaaggcttttaacaacaatctgccggattgtgtgttaaacaaaagattctaatttaaacataactaaacttaaggtatgaagaccaatttacgtctattatttacgttgctctttgtggtttcggttgcagcattacatgccgggacaatgaatgacatacgtgtttcgggcactgttgtgtccgaaggagacccgttgcccggtgtatcggtattagtgaaaggaaccagtgtcggcaccattacgggtatcgacggtaagtattccattaatgtaccgtccgatggtacgctggtattcagttttatcggactgaaatctgtggaacataaagtgggtggacgctcagtgatcaatgtcgaactggtgcccgacagcaaacaattggaagaagtgatggtagtagcctatgccactgccaagaaatatagtttcaccggcgctgcctctaccgttaaaggtgacgagatagcaaagttacaaacctcgagtgtatcacgtgcccttgaaggaaccgtagccggtctgcaggcaagtgccgcaagcggtcagccgggtaccgatgcaaccatacgtatccgcggtatcggatccatcaatgcgtccagcgcacctctttatgtagtggatggtgtgccttatgacggcagtgtgaactctatcaaccctgaagatatcgcatcgatgaccgttctgaaagatgcggcctcggctgctttgtacggttcgcgtggagccaacggtgtaattattatcaccaccaagcagggacaaagcgattcgaagactacggtgaatgtgaaagccagcttcggtggttccaatcgcgcggtacgcgattacgaccggatcggcaccgatcagtacttcgaactttattgggaggctttacgtaaccaatatgcactggatacaaagaattatactcctcagacagcggctatcaaagcttctaaagacttggtaggaaaactgatggggagtggtcccaatccttatggggctaaataccctcagccggtaggcacggatggaaaattggtggacggggccgttccactctggaatttcgactggcaggatgccatggagcagcaggcacttcgcacggaattgggattgaatgtctcaggagggggcaaaaccaatcaatattacttttctgccggatatctgaatgataaaggtattgccttggagtccggctatgaacgctttaatctccgttcgaacgtgacaagccagatgaccaaatggcttcggggaggagtgaacatgagctttgcccactctttgcagaattatcctgtatcatcggatacgaaaacaagtaacgtcatcaatgccggccgtctgatgaacgggttctatcccatctatcagatgaacgaagacggaacctataaactggattccgagggacagcggatatacgatttcggttcttaccgtccgtccggttcgatggctaactggaaccttccggctacattacccaatgataagtcggagcgtatgaaagatgaattttcgggacgtactttcctcgaagttacctttatcgaaggattgaagtttaaaaccagcttcaacttcgacctgatcaattataattcactcgactataccaaccctaaaataggcccggctgttaataccggaggttcattgagtcgtgaaaacgaccgtactttttcgtggacttggaataatatcctgacttatgacaaaaccctcggagagcatcatttcaacctgttggccggacaagaggcttattcttaccgttacgatgtgttgcgggcatcccgttcgaatatggcattgcctgattttcccgaactggctgtcggttcgctggtaaccggagggacaggataccgcgttaattactcgttggtaggatactttttaaatgcccaatatgactatcaaagcaaatatttcttttcaggttcttatcggcgggacggatcttcccgttttgctccagagacccgttggggtaatttctggtccgtcggtgcttcctggcgtatcgatcgtgaagacttcatggtggctacgagcgactggctttctgccctaacattgaaggttagttatggtgcgcagggtaacgataatttgggaacgtattatgccagcagcggactttattcggtggtgagcaataacggagagaatgcattggtatccgatcgtctggctacaccaaaactgaagtgggaaaccaacctgaatttcaatgccggcattgacttctcattgttcaacaatcgattctccggttcgttcgatttcttccagcggcgttcgaaagatttgctctattcccgtccgttggccccttcactcggttataattcagtggacgagaatgtaggcgaattgaagaataccggtgtggaaattgatctgaaaggtaccttaatccatacccgggactttatgtggcgattggggcttaacctgacacattataagaatgtcgtgactgaccttccattgaaagatatgcctgtgagcggagttcataaactggctgtgggacgttctgtttatgatttctacatgaaaaaatgggcgggagttgatccggaaaacggtgatccgttgtggtacaaaaatgtgaaagatgccaataacaagatcaccgggcgtacgactaccaatgactatgcccaggcggattattactataccggcaaatcatctttacccaaagtgtacgggggatttaataccgctttctcgtataagggttttgaactatcgacaatttttgcctatagtatcggaaattatatcgtggaccgtgacgtgactatgctatggcataacggaagttctaccggacgtgcctggtcgacagaaattctgaaccgttggacaccggagaatcgatatactgatgtaccggcactgaaaaccgtatcgaacagttggaatgcaaattcgacgcgtaacctgtttaataactcgttcctgcggatgaagaatatcacactatcgtataacttcccgcaaccgatgataaagaagatcagcctgaacagcctgcaattgtttgtacaggccgataatctgcttaccgtttcgaagaatcagggactcgatcccgaacaggatatcagtgggttgacatattaccgttatccggctatgcgttccatttcaggaggaatcaatgtttcgttctaaggttttaatccccagaaaagggctgttgcaatagtatgcttcgccccgatttaatcatgtataaatcatatataacagatatagtaaagtataaaataacagatgatatgagaacaatacgatttaacaataacagacatatttcttcttctcctcttcttcggacagagggtgggagagaggcttccgtgagtaatacctccggagataagattcccaaaggtaaggtttcctttttcctcctcttctttcttttgttcttggggagttgcagcagcgacttcctcgacaataagccgacagatgccgtagattccggtctcgtacccgtgccttcgaatgccgaacgcatctttaacggtgcgtggtacaatctgttcgaatatggtaccacttatgccaacatcggctatcgtgctttgatgtgcctggacgacatgatggctgacgacgtggtttcgcgccccatgtacgggtttaattcttcttatcagtttaatgatgtggtgatgccctccgacggacgtaccacttttgcctggtatctgatgtataagactattgataactgtaatacggccatttctatccaggctaccggagacgatgatacaccggaattccggcatgcccagggacaggcacttgccgtacgtgctttctgttatcttcatttggcacagcattatcagttcacctatctgaaagataagaatgctctttgtgtgccgttgtataccgaacccaccaatccgaataccaaacctaaaggaaaggccacactcgaagagatctatacacagatcatcaatgacctcaaccgtgccaaaggacttcttgacggctatgtacgtccgaacgacaagtcgaaatataaacctaacaccgatgtggtaaacggactcctggcccgtacttatctgctcaccggacagtgggacgaagctgccaaagccgcgcttgaagcagccaaaggctatactttgatgacggacgccaaaaactatatgggtttcaacgatatatcgaataccgagtggatctggggacatccgcaatctgtcagccagtccgatgccagctataacttctattatctggatgtggtggaacccgattcatataatagttttatggccgatccgcatttcaaggatacttttactgaaggggatatccgtctggaattgttccagtggatgcgtgaaggttatctgggataccgcaagttccgcatccgttctgaccagacgggcgatattgtcatcatgcgttctgccgaaatgtatttgatagctgccgaagctttggcgcgtaaaggtcaattgggcgaagccgtaaaaccgctcaatactttaaggaatgcccgcggactggccgattatgatcttaccggaaaaacgcaagagcaggtaattgatgaaattctgatggaacgtcgccgtgaactttggggtgaagggtttggtatcactgatgtcctccgtacgcaacgtcctgtggtacgtgtcgcactgactgatgtggaagctgctaaggagtacgattgttggcagcagaacggtactttcaagaagtatcatccggaaggacattggttcaccagctttcccgatggaacgaagtttgtgcccaatagtaagtattatttgtattctattcctgaaaaagagacgaatgcaaatacgaatctgaaataagaaatcatagtcaactgattttatatgacctgtttctgaaaaatcagatagattaatacaatagacaaaaggtgtgtcataactctgcggtgaataagagttgcgacacaccttttttatcaataccgttaatggttaactgaatatatacacaatgattcccgtaatgactacataagccagtgcatatggaatggctgcttttaggatttctccttctttcccttgttggtttcctgccgatgtagcgatggcgatactttgaggagagatgattttgcctcctgtcgcacctaccgtattggcggctgataaccagtccggactgacattgatatgtcctgccacactggcttgcagctttccgaagaggatgttcgaggatgtatcacttccggtgatgaaggtacccagacagccgataaccggagcaaagagagggtagaggcttccggtggctgtggcgagtgcagtggcaatcacggaaatcatgcctgccgtatccataatggtagataaccccaccaggcagataacggtgacgaacgttttctttaattgtttcaccgtgttccataaaacgacaaacagttctttcactttggctccctgtatcagaccgcctacaaacgtgcctacgaaaagcagaactccggcatgtgtcagccaggcgatggtatagttcacgctggagtcattgatggggaggctgatacgtgtcacccagttattttcgagcgtacttcggagtcctgggaaaagcggactggtcagtatgatcagtaacaaaatcagcagatagatgctccaggcattcaggatatctttccctttcagtgcgttctgctgcgctttctcttttttgggggcagtcagtttgccataaatgacgataacgacgatagacaagatgctgccgatgatagccggtgattcggcccccatatatcgggccgcaacgtactggctacctaaagatacagcgcctaccagcagtgccagaaataggtttttaggtaatgattttattttcgggtcggtcaggaagagcagtaccaacggtatcaggaacattagtacggaaagttgcagtacgacgttcgtactcagcacctgtacatccagattggtttctttggcaagtaccagtaccggtgtacctatggcaccgaaagccgtagccacactattggcaatcaggctgacggtagctgagaaaatgggtttgaatcccagactgatcaggatagcggcggggatagcaacagctgtaccaaaacctgccatagcttcaagtaaccctccgaaaccccaggtaaggagcagtacctggatacttttatcggtagagatggaagagaattgttgtttgataatctccatcttctctgttttcagcaatacattgtagctgaagatagccatcaggatgataatcaggatgggagaaactgctttcagtgcaccgtatacgaatgaaaataccaagttgtctaccgcataatggaatccgaaaagagctatcagcatagttactatgagggagatgacgctacttttgtcacccggcattttaaaaaatgccattaatacaatcaagagcaataccggaacgatggcaaggatcagtgtcataattgtctgtttttaatagttgatgtttaagttaagatattgatataacaaaaccggaacctgttttgacggatgaaataattatttttttgctgtatagcgttaaataaaaaaaggtgtagccctccgcatggaaaggctacaccctttggtccggatagctacaccctttttatcggatggctacaccccaatgccggggatttattttttcttcatattcaagatctgttgcagttgctgtaggttggctttagcggcctcgttacccatctgggcagcttggttgaaggcagcgacagcacgttgtacatctccattgaggaagttgtatacacctacgttgttgatgaattctgctgtttgatggttggctttatccatatacttgattgcgttttccagatctttcttggtcagtgatacggcggcggcattcaggttggctacttcatcgttcggatacatacgtacagcgatgtcgaatacattcacgaagtcgttgcttccttttggatagctgttggccacctgatacatctcattcagactcaagtatttcgggttgacttttatcaccacccgtccttgctctacatcgaagttggctacggtgtagtctatcttgcagttcactttgcggagtccgggataaatctctttcaacatcgtacggtagggtacgcctccgtccacgcgcatgatttcctgtttgcggcgtgcatcgtcagtcgtattcttgatgataccgataaatttatctttatctttcattgacgatttttccaatgcttgtaccaatccgtcccagttttcaccaccaaaagttactttgtaaagtttgccgggaactttttcgttggtagtcagataattcttcagagcttcggcacgtttctgcgacagttgttcgttgaatttcaacggaccctccggtgaagcgaatccttcgatactgattcctgttactgtcaggttcttgtcattctgaatcttgtcgaacatagcatgaatgttcatcagctctttgtggttattcatgaattccggctggatcacagctttgctgacaggaaagtcgaggtgagcttcatactgttcgctacggtttttcacaacttctacggtaggctgaatataagcaaccaccggtaccatggcgctcaagcgtttggcttcggtagagacgtcattagtgatcagttcctgtgcgagcatctcttcgttattgccgcatccgcagaggttttcaaccagattcagtgaggcatttgccatccagggttcataagggatcacctgggcatagttgagcacttctcttttattataaggtattacgattcctgcaggtagttcgcggctgatggctaatccgcgcaaataagccttctgacggcgtttgccgttgatgatgatctcttccagcgctacgttgtgctgtccgtctgtcaggagcggagtaagtgtgagcatacgttcgggactgaccgttagattcttcatgtcgatctgcatgtctacataaagcgaattgccttgttgccatagcgaaacatcggatagactgatggcatctttaaagaatttctgggcactggccggcataacaactgcgagggccaagaggaaatatatgatttttcttttcattgttactattgatttaattttttataattggttccggagaatgtgtgtggggctttacttgatagtataaataatgctgagtcctattttcgtcgggccgaaataattcttgttgttatgtcccagcttctcaccacacttgccacacgcatatttatcataattcaggcgggcatatcctgcaccgatggtagcttccatgctccagcgattcttgagtatccaatggtaaccgtaagagatacctgcaccatagattttgccgtcataacggtagttgcccaacccgaatatatcgagattgctcatgtttacatcggcgtaatggccgtgcaggccgaaaaagctaccgttgaaacgttcgcaaagccagtaacggagttcgggttgtaccagccagtgcttgatttgtctgtctttggagaatttccaggggttgtagttgcccgatacgtcaagagtaagttttttcgccaaagccacttcaaatcccaggttcggagtactggtggcccagtagagggcattggttttgatggcaaacttgggcagataagtttttgttccctgctcttgtgcatgtatgcctgtggcaaacacaagcaggaagcatgctgctaaaaaatgtttgattgttctcattttcattttggtctaggtttttacataaactatttgcgagattaaacgtctgagaggggaagtttgttgactcatactcaaaataatgttataggacatgcacgctaacatttttaagcaaataattgttatcctaataaagtcgggattccaaacttttcattttcttcgggaaagagagtgaaaataaacgagcaattgtaatttggattacatctattctcttttttacatgctaactttacatatactttaaaataatagcctatgaaagagcttatcaatcgcctggaagagttgaacaggcaagctgaaaaaggtggcggagacgcccgtatcgagaaacagcattctgtcggaaaactgacagcacgtgaacgtatcgacctgcttctggagaaaggatcgtttattgaactcgataaactggtcacccaccgttgtaccgatttcggtatggagaaacagaagatttccggtgacggggttgtgactggatacggaatgatcggcaaacggcttgtttatgtctttgcccaggactttaccgtttttggcggtgcactgtccgaaacgtatgccaagaagatttgtaaagtaatggatatggctatgcagatgggagcacccatcatcgggctgaacgattccggaggagcccgcattcaggaaggagtccgttcgctggccggttatgcggagatattcttacgcaattctttagcctcgggtgtcattccgcagatcagtgccatcatgggcccgtgtgcgggcggggcggtctattcgcctgcattgaccgattttatcctgatggtgaaaaattccggttatatgtttattaccggtcccgatgtggtgaaaagtgttacacaggaagaggtcagcaaagaagatctgggaggggcggatgtccataccatgaagtcgggggtggcacatctctctgctgaaaatgatattgaatgtattaattacatccgtgaactgatttcttatctgcccggcaataatatggaggaacctccgtttgtggctaccaccgattctccgacgcggcttacgcccgaactatcggaactcgtgcctaccaaccccaatcagccatacgatataaaagagatgatccgtgccgtggcggatgataatagtttctttgaattgcaggaagaatttgcccgtaacatcgttatcggctatatccgcctgaacgggaaaacgataggagtggtggccaatcagccgttggcactggccggaacactcgatatcaatgcttctatcaaagcggcacgctttgtgcgtttctgcgatgcgttcaatattccgttgctcacgctggtcgatgtgccggggttccttccgggtgtggatcaggagtatggcggcattatccgtaacggtgctaaactgctctatgcttattgcgaagccactgtacctaaagtgactgtcattacccgtaaagcttatggcggtgcttatgatgtaatgagttccaagcatatcaggggagatgtgaatctggcataccctactgccgagattgccgtaatggggccggacggtgcggtgaatattctgttccgcaaagagattgacaaagctgcagatgccgaggcgaaaagaaaagagctacaggatgattatcgcagtaaatttgccaatccgtaccgagctgccgaattgggctatgtagacgaggttatcgaccctgccattacacgtatgcgcctgatacgcagttttgagatgctcgctaataagcggcagtccaatccgccgaagaaacattcaaaccttccactttaaagcagaggagaacatcgtatgataaaaaagatattagttgcgaaccgtggcgagattgccatgcgtattttccgtacctgtcgggtgatgaacattgctacggtggctatttatacccgcgtagaccgtggtgccttgcatgtacgttatgccgaagaggcttattgtatctccgattcgccggaagatacctcttatctgaagccggagaagattctgcagattgctaaaaagacgggagctgccattcatccgggatatggctttctgtctgagaatgcagacttcgcccgtcgttgtgaggaagagggggttatctttattggtccgagtgccgatattattgcccgaatgggtattaagactgaggcccgtcggattatgcgtgaagccggtttaccgatcgtaccgggcacggaagatccggtgaaaggtattgccgaagccaaaaaggtagctgccgaagttggctatcccattatgctgaaagcacttgccggaggtggtggaaaaggtatgcgtctggtacgcagtgaagaggagatggaaaccgcacttcgcctttcgcaatccgaagccggaacttcatttggcaacgatgccgtttatattgaaaaatatatcgagaatccgcatcatattgaggtgcagatactgggcgataaatatggcaatgtgattcatctgtacgaacgtgaatgttccattcaacggcgtaaccagaaagtgatcgaagagtcgccttctccttttgtgaagcccgaaacacgtgccaagatgctgaaggttgcagtggaggcctgtaagcggattaattattacagtgccggtacgctggagttcatgatggacaaagaccagaacttttattttctggagatgaacacccgcctgcaggtagaacatccggtgacggaagagtgtacgggagtggatttagtgcgagacatgattctggtggctgcgggcaaccgtctcccttaccggcaggaagatgtcgaatttcggggtgctgccatcgaatgccgcatctatgccgaagatcctgaaaacaactttatgccttcacccggggtgataaccgttcgtgaagctcccgaaggacgtaatgttcgtttggatagtgcggcttatgcgggatttgaggtttcgttgcattatgatccgatgattgccaaactttgttgttgggggcgtaaccgtgattctgccatttcgaatatggcccgtgcactgcgagaatacaagattttaggtatcaagactacgattcctttccaccagcgtgtgttgaagaatgcggctttcctgaaaggagaatacgatactacctttatcgacacccgtttcgataaggaagacctgaagcgcaggcagaataccgatccgactgtagcggtgattgctgctgcgctgaagcactatgaagaagaaaaagaggctgcttcacgcgccactacgcttccggtagtaggagattcgctttggaaatattacggcaagttgcaaatgactgccaataactattaaactcagaatgattatgacaacaatattagcaacctattatgccaagatacaggatgtgcccgacagtgaatataaagtggagatactggaagacgggcctgtgaagaaagtggcggttaacggaaaagtatatgatgtggactataatgtaggaggtgattctatctattccatcatcatcaatcatcattcgcacggagtacagatatctccgacttcccattcctcctataccattatgaataagggggaactttatcagattgaactgaaaggggagttggaaaagattcataatgcccgtaacggagcagatgtcgtaggacgtcaggtggttgtggctcctatgccgggtgttatcctgaaaacttatgtgaagaaaggagacgaagtgaagaagggtgatccgctatgtgtgttggtcgccatgaagatggagaatgaaattcgttcggtggctgatggggtggtgaaagagatttttgtggaagaaaatacgaaagtgggattaaatgaccgcatcatggtggttgagtaacaaacaggtatttaagaggtaggggctctggaagtttttatttcagagctctttttatgtgtattgttatctttcattgaaatagatatagttagcttttggagaccggtataagatattcttaatcattcctaaaaagaacttgcttcgttttgtcaattcagaatctgttcgtagttttgcgaacaataaacaatgggagaatggtaaagtgaaaacaaagcagtacacagaaaagcaggagcagcttgcccgctttgccaaggctatgggacatccggcgaggattgctatccttagtttcttagcgaaacaggatagttgttatttcggggatatccatgaagagttgcctattgccaaggcaaccgtctcacagcatttaaaagaactgaaagatgcaggattgattcagggagaaatagaagcgcctaaagttcggtattgcatcaaccgtgagaactgggagtttgcccggttgttattcgtagagtttttaaacgattgcacctgtaccgggacatcatgttgtgggtaaagggattttttttatgaaatctgttcgtgtatttacgaacagatattcttgcaatacgattttaatgaagagtatcggatacggaagattatagtatgattaaaaatgagaacaagatggaaaagaatcagataaaaaacaatcaagatttaaaggagttagtgaaacaacgttatagtgagctcgctctgaatgcagaagagctgaaaggttgctgttgcggtagaaaccccttggctgcttcaaaaaaagtatttaccataatgagtgaggactatacaaatttgaaaggttatgaacctgatgcggatttaggggtcggctgcggattacctacacaatatgccaatatcagtgaaggtgatacagtggttgatttaggttcgggagcagggaatgattgctttattgcccgtgcggaagtaggtgaaagcggtaaggtcattggtattgacttttcccctcaaatgataacaaaagtacgtaacaacgcacttaaacggggatatgccaatgtggagttcttagaaggtgatatagagaatatgcctttactggataatacggcagacgtcgttgtgagcaactgtgtacttaatctgcttcctgaaaagaatattattttcaaagagatttatcgtgtgctgaagcctggcggacatttctgtatatccgatgttgtacttaatggaacattccccaaaaagtttactgataatgcggcgatgtatgcagggtgcatcgcaagtgctattcaaaaggaagattatttgcaggagatagaaaaggccgactttgtggatattcgtattgcgaggactaaaacggttcttattcctgatgaagtgttatatgaacatctggatgaagacacgatccgaaagtataaatccggaaatgtcgggatttactcaattacagtaacgggagaaaaacgatctgtgtaatatgcggattcttaattctttccgtttaaatggatataattccggttatcgctgattctgcgttaaccggaattttatttggaggggagtcgggcttttctacgtgagattaaattttattcttgtatattgttcctcccttcataatcattgcgaaatttctttccggatcgcccagtagtgtaatgtctttcagtacatctccatccaccaggattaaatcggcccaggctccttcttctatactgcctaactttcctggataggggtttcttgcaccggataaggccagtaactccgcattatcatgtgtcaccattttaagaatttcaaaattgctgaaccatttctgtaatttgaggataccttggttctggtttttcgtattggccggattgaatagtaaatctgttccccatgccaacttgaccttatatttctttgccagttgatatgtctggtctgtaccctgaactactaaagcatgtttctcctgctgttctttcgtagggaactgattatctcccaaagtgaaaggctgcatactgagccatatctctttctccgcaatcagttccatagtcgcctcatcaatcagatgtccgtgctcaatactttttactcccgcatggatagctcgttgaatagctctgggcacatagacatgcaccattacataggttcccgcatcttctgccgctttgacagcagcatgaatttcttcttcaaaaaactgtgtgtcttccaatcgatcgtatagggaagcaactccgccgcctgtcatcaacttgatctggctggctcccaagcggagattgttgcgtgcggcaacagttacggcatccactccatcggcaataatggcagcaccgatctcttccgtatgcgttaatccgcaacaatcgaatggacgcggttcgtcatacaccgctctgaaatctccatgtcctcctgtctgagagataagggaaccgcttggatagatacgtggtccggaaagaatcccttcatcaatggcccgttttagtccgaagaccggaccaccggcatctctgatggtcgtaaatccgcgtagtagcgtggcctctgcttcctgtccggctttgaattgtgtataagcggtgtcagcagtcagcagatccatgattgtattgcatgacatataagcatgccagtgtgcatcgattagtccgggcatcaggaattttccctttccgtcgatgatagtgggattactaattccgtctgtagggatcggagtttctgaaatggctttaatccggctgttttctatcagtacatttccctggatagtctgctcgtggctgccatcgaatatttgaacgttattgattaaaatacttttatccatgatacatcgtgaatgggtgaatactggtggtataacccgtgagggaaggtattggtttacttaccgggatgataaacttcgttaaccgggaaatactgcgtctgtattctaaaaaactttactaaatatggagtgcccttctgtctgatgattttgattactctatatgctgttttatgtcttgtcattattaaaatagaatatttttcttgtccggaataattaaaatgacctaattagaaagttctaataactttccacattgtactatttacagtactttcatgcatagattacttctttttgatagactgtacattaaccttaattgctgttgatttgaacctattctttttgctgtacgttctctttttatagacgaagtaattgaacccgtcacatttcagccggtaaatgtggcatattgtctcactattaaacacatatggatatgaaaactttattcatttttctatttgttttgcttgcattctactcctgcgatacggacgaaccgatcagtgcagaggatttatcggctgcaaccgttacgaatatggatgatgtcgatgtagcttcccgtccgggaaactacttaatctggctcaatggaacgagtgcggaaacaaagaaagttgcagttcgactgcaaaccgtgaaccactacgacaagatgatatcttttaatgatctacccggtacagataagctggcaacgttggaatctatggcaaaagatacattgaacgacctgacaattgtaggcaatgtcgctgactttttagcaggtacttataattttgaaatgatacaggatatccgtcacaatcgtcagggagtgattttaatagccaaagatggtaaggaggaagatttgaaggaacagatgctgaaacttttcggactttatgtagataaagggtattataaagttagcttcccgcgcgagcagcgttatgcttattatgacacaaatgatccggacgctttgaagaaactctgtggcacgaatggtcttaacccccatacccgtagtatgctttcttctcccggtccaacggatgatccttctgcccctgaagttaccgaacgggctttgcatgctatgaagaaaatttatatcagtaaccggttctatgtttataccagtgattacaagtatcatatgactggatatgaaacgttgttaccttatactgctgaaacaaggaattatgctccaagggaagataaaaggtatgatgggatggttgacagagaatggactattgacgcttataatttacgtatttatgcgccaaccaatggagataatatgcttgctgtttacagttcgggtggcaacggattttctaacaggctcgataattcattggtatctttgaataatccacccatgtatgaactctgggcactgatatggggattacggaataatgcttatacaaagattaatatccgtgacgacgaacagtctcaattagatctcaaattggttgattttgcaccaggactgccgcaaaccgagagtaccattgaacatgcgtatgaaaagagtgtagggtttgatttgggagcgagtcctgttttaaagggtgagtatcgttggggaaagtctatcatctatcagctggcggaaatgacccgtgaagtgacccgtactattaccgatgctgagatggattattgctggaaatggtatcctgaaatccttttcaaggggaataaagcaatgaaagcagatggtatgatcgatggggttgccatgatttcgcccgcatggtatgatattctctacaaccatgtggcgggaactccgggcacggataatgttttttgcgattataacaatgacttgcagtttaaccagaatttgctcaattacaatcaggagtgtgctattactgctcgtacaaccggcgcgtcggcgggtgttgtagccattgaaataactgacggaatggtgttacagcgcggaggagcctggttcacgagttggggagccgcagtgattcatcctttgccaagtagtgccggcactgcttatgatgccacagtagatgtgcataaaacaactacggtgtggattgactataataactggtaaaacgaaccattaaaaaaagattattatgaaaacaaaaatgatatatgtgctacttctgttctcaagcattcttttaggggcatgtgttagggatattatcgatgatgttccggtgcctgatgaagataatgagatcgataagaaagatgtagtcttggtacgcatgggaactgatgatgcggaagtgaaagatattacttcccgtttgttcaacaacattcccacttcctgggaaatagggaaaaagacaattgtggactatgataagatgacaaatcctgagacagaactcgatgccgatatcaagaatccggatatctatgtgacggttatcctgaatatcaaagatgttgtttccggtaaatatccggtctctctgttccgcatgctgaagttctataagagagatttctatgttattgccactcaggatactccggaacaaaagaacgaaatgctttcattaataggagtttatatggagccgggttattatgccattaattatgataatgtgcagcattaccgaatctttccttctgccgatccatatgccaaaaacaatatgattggtaagggagcggcctctttcaaccagcaactgttgacccgttctgcggatattttgcccaaaggtaccgatccggatcctgcatataatgcacaaatggcagataaggaggctttgaagcggatagaaatttataaccgtatctacggttatgctcagggggatatgaactattccatgcaggcggttccttataagatgaaagagggggcagcacccgatgtgattatagataactcctgggcgatagatgcctataacttccagatatacagtaagaacaacaattgtatattgagtataacgaacgacgcgggaaatggtttcactgctaatatcaaagactatacaacgcccaaaggagccaatgtctatgcttacatctggaacctgatgcgggaagcctccagtgagatcactgtccattcggatgggggtattttccgggaaatcagttatcagccgcaaacggtgaatcatggaaccaactatacagagaattctttttggaaagtatctgtatccgtatcacctgctgaactggaagaaaaaccttggaaggctttcaaagtatcgtttggcaaggaatcgtctactgaaatatcttataaaacattgtcgatggattactcttgtaaaggacaatatggcaatgggctatacagtaaactctggcagtttattcccggagagttttatgatagagcagaagcctttgtttacgaaacgagcgaggggttgcggtggattgatgctgcgcaggcaatgactcccaattatgtaacatgggggggctggactcttcgccagaattatctggctcacatcaacaatagtatgaagctccatcggcagcagtgtatttattctctggaagctgatgcgcaacccggagttgtttctgttgccattaccgatgctatcaatttgcaaaagacttatgtgcattataactgtggtattcgctatggacacgattcggctaaaacggatctcaaaatgtcgaagatggtttggattgatttcaggcagtgggacaattgaaacatctaattaatacggaaaaagttatgcgaaatctctgttacaatacggatatgtgtagcccttatatgccttattcagatgagaagtgaagtgtttcagtcggtcgccatctccccggaaaggaggtggcgacattgtctgtaaatgttgcttttttaaatctttgttaattgcttgggtgagccatgccaggaacaccccaagcaatatacttccgtaaagtcgaatccctcagttgaggcttccggatatttggggactactgttccattttgggtgatgtatactaataaccgctctccttggctgttttttacgtacataccagcgattttgcactggggacagagtaatttcttcatattactaaaaatggattctttggtaaaatgttattttataattgtttttatctgtatgcctataaatcggatgacattctacaagctctttaaatctcagctctctgcaaatatgaatagcagatttagtaaaactacttctatctaattattttgagaagagatattcctattctttggtggtctgccaaagatttctctgtggtctgccatcacttattgatcgcatttcaacagggcttgcctataaataatttttctatttggaatatcataaatctcggtgaccgaacccttctttttaccctgttctgatatatatttatccagcgcaggatatactttgataaaaccaataaatatggaaagcccgtttttgagcggaagttcagctgttgcatagtcttctgacggtagaacttttattttgtatatgcattcgttgatagacaaacggttagtgtctttagactcaatgatgcaaccgatttccgaacgtagcttatccttggctatttctttcggattatcataaaagatacctatgcctctgttggcttctattttaagtttgtacaacaagtaataatagatcttgttggttattgctttagtctgtttatagtcgcctgttacttcttggtagacaatagtttctccaccggacttttgggtacttactttaatctcggagaatccgcccaagtaagcatagagccccagcaataatactaaaaggattatgattaacatcaacagtgtcatttcttctttttattaatgataatgttatgaccatttttaatggatgctgcaaaagtacatatttccttcttatgtttatggtaaaaaagcgacttgttacttttgttctccttcttcatatgaaagatacgggatcaacttaaaactaagctctatccttttttgttgttaatagtaggaataacttaaaaattatacgattatgaaatatgatatagctatcattggcgggggacccgctggatataccgctgccgagcgggcaggagcaaacggattacgtgccgttttgtttgagaaaaaagcaatgggtggcgtgtgtctcaatgaaggatgtattcctacgaaggcattactctattctgccaagatacttgatagcatcaagagtgccccgaaatatggtgtctctgtagatagtgctcccacatttgatatggaaaaaatgattaaccggaaaaataagacggtacagaaactgacgggtggggtaagaatgacggtgaactcttacggagtgaccattatagataaagaagcggtgatagaaggtgagggtgaaaatggcttccgcatccattgtgacggagatgtttacgaggtgacctatctgatggtttgtacaggatcggatacagtgattcctcctataaaggggctttcggatatagattactggacttcgcgtgaggcattggacagtaccgttcttccctcttcacttgccattatcggtgggggagtaatcggaatggaatttgcctcattctttaatagtatgggcgtcagggtacgggttatcgagatgatgccggaaattctcggagtaatggataaagaaacgagtgccatgttgcgtggcgactatacaaagaaaggtataaacttctatttgaatacaaaagtaacagaagtgagtgataaaggggtgacagtggagaaggatggaaagatctcgtttattgaagccgaccggatattggtaagtgtaggtcggaaagctaatatcactcaggtaggattggataaactgaatatcgaattacaccggaacggtgtagtagtggatgaacatatgttgacctctcatccacgtgtatatgcttgtggtgatattaccggttattcactgttggcacataccgctatccgtgaggcagaggtggctgttaaccatattttgggtatagatgattcaatgaattataattgtgttcccggtgtggtttatactaatcctgaacttgccggcgttggtaaaacagaggaagaattgatggctaagggtatttactatcggatacagaaactcccaatggcttattcgggacgttttgttgccgagaatgaattaggtaacggactctgcaaactgattatcgatcataatgatcgaattatcggttgtcacatgctgggtaatccggcttcggaaattattgtcgtggcgggcattgctatccaacggggctatacggtcgatgaattcagaaagagtgttttcccacacccgacagtcggtgagatttatcatgaaacactgtttgcttgatgcgtttcatcaacagtctttcaacggatgctggttttaacttggctgctgaggagtatttgctgaaacagggtacggaagatgtattcatgctttggcaaagtgctccttccataattatcggtaagcatcaacggatggaagcggaagtgaatttaacggcagcaggtgaaaagcagatccctgtattccgccgtttttccggtggtggcgcagtatatcacgatctgggtaatatcaatcttacatttattgagactacccgcctggcacgttttgagacttatctggagaaaacgattacaatgctgagtgctgccggagtggcagcgacgggtgatgaacggttgggtatttatgtcagtgggcgaaaggtttcgggcagtgcgcaatgcgtacatcgcaatcgtgcgatgtatcattgcacattgctgtatgatacggatttgaaactgctgaatacactgcttgccgtagccccgtcagaggaaaatatcagattacatccttctgtacgttcggtccgtagtgaggtgacgaatctgaaagagtatttttatccggctatacctacagataggttccggaattggattttcagatattttgcagagacatcggtctccgagggattcaacaaggcagaacaaacagtcattgaagagttgcgcgggaacaaatacaatgcacttgatgaagagtcatacaggcgatctaccagacctcgttaatcaaaatataaagtttttagcttaccggtctcccgatatatgcgttgaatgtatgtactattaaggtagtaataggagtactttgattccggattgaattataaacagttttctcagatgcttattaatcttcttttttcaagctattacttaaaaaaaacactaacttaaaacattctttttcaaaatcttgttctacttaaacaagtgaaagaataaataattgtatgtatggcaagattcgaaataaaaatgcccaaactgggcgaaagtattaccgaaggaaccattctgtcatggtcggtacaagtgggtgacaggatcaatgaagatgatgtgctttttgaagtaaacaccgctaaggtgagtgcggagatcccttctcccgtttccggaaaggtggtggagatattgtttaaagaaggtgatactgtgcccgtgggcactgtagttgctattgtagatatggatggagaagactccgtagaaacatcggaaactgaaggttccgcagaaggtacatctgtttccgaagcggcggaagtttcaagtgccgcgtctgctccgaatgtgaaagcggaaactactgtctcgaaagtagaacgttggtactcaccggtggtgctccaactggcacgggaggcaaagattccccaggaagaactggatgcgatccccgggacaggttatgaaggacggttaagtaaaaaagatatccgtcattatattgaaatgaaaaaaggtgctccggttgccgatgcccctgttgcggtgtcttcagcggttaaggtaaacactcctgcttcttcacctgcgactccggttgctgctgaaatgccaaagaaacctgtagctgtggcttcccagtccctcaacccctctgtttcggacgcatcggtagaggtgaaagagatggatcgtgttcgtcgcattatcgccgaccatatggtgatgtcgaagaaagtttctccgcatgtgaccaacgtagttgaagtcgatgtcacccggttggttcgctggcgtgaaaagaataaggatgtcttcttccgtcgtgaaggggtgaaactgacttatatgcctgctattgctgaggctacggcacaggcattggctgcctatccgcaagtgaatgtgtctgtggatggatataacattctgtataagaaacatattaatgtcggcattgcggtttctcaggatgacggaaacctgattgtccctgtgattcacgacgctgatcgcctgaatcttaacggacttgccgtagctatcgattcgttggcgaaaaaggcccgggtgaataagctgatgcccgatgatattgacggaggtacgtttacaattaccaatttcggcacttttaagatgttgttcggtacgccgatcattaaccagccgcaggtagcaatacttggcgtgggagttatcgaaaaaaagccggccgtagtggagactcccgaaggcgatgtgattgccattcgtcataagatgtacttgtcgctctcttacgatcatcgggtggtggatggttcgctgggaggtaacttcctgcatttcattgccgattatctggagaactggaaagagtgactgctgtgtgaaactaactaaaaagattgaaaatgaagaaatatgatataaaaaccactgacgaacagaccctccgcaagtggtatcatttgatgaccctgggtcgcgctctcgatgagaaagcacccgcctatctgctgcaatcccttggctggtcttatcatgctccttatgccggacatgacggtatccagctcgctatagggcaggtctttacccttggtgaagactatcttttcccttactaccgggatatgcttacggttctttctgccggaatgacaccggaggagctgattttgaacggaatttcgaaagctaccgatccgggcagtgccggacgtcatatgtccaatcactttgccaaaccggaatggcacatcgagaatatctcttctgctaccggcacacatgatcttcatgcggcaggcgtgggacgcgccatggtatattatggacataaaggtgttgcgatcacttcacacggagagtccgccacttccgaaggctttgtctatgaagccatcaacggtgccagtaacgaacgtcttccggtgatctttgtgtttcaggacaacggttacggcatttctgttcccaaaaaggatcagacagccaaccgtaaagtggccgataatttctccggttttaagaatctccgtatcatccattgcaatgggaaagatgtgttcgactcgatgaatgccatgaccgaagctcgtgagtttgctattgccaatcgtactccggtcattgtccatgctaattgtgtccgtatcggttcgcactccaattcggataagcatacgctttatcgtgacgaaaacgagttggcttatgtgaaagaggccgatccgttgatgaaattccgccgcatgctattgcgctataaacgcctgacagaggaagatctccagcaaatagaggctgccgctaaaaaggaacttgccgcagccaatcgtaaggccttggctgctcccgatccgaaaccggaaagtatttatgattttgtacttcccgaaccttatatccctcaaaagtataaagacgggcttccgggacctgttgaaggagagaagagttttatggtgaatgccatcaacgaaactctcaaagaagagttccgtcgtaatcccgatacatttatctggggacaggacgtagccaataaggataaaggaggtgtattcaatgtaaccaaaggtatgcagcaagagtttggtgatgcacgtgtattcagtgccccgattgctgaagactatattgtgggaaccgctaacggtatgtgtcgcttcgaccctaaaatacatgttgttatcgaaggagctgagtttgccgactatttttggccagccgtagaacagtatgtggagtgtacgcacgagtattggcgtagtaacggtaagtttactcctaatataacacttcgtctggcttccggtggttacattggcggtggattgtatcattcgcagaatctcgaaggggctcttacgactttacccggtgcccgcatcgtttgtccgtcgtttgccgacgatgctgccggattactccgtaccagtatgcgttccaaaggtttcactctttatctggagccgaaagcactttacaactcagtagaggctgctgctgttgtgcccgaagaatttgaagttccttttggtaaagcccgtatccgtcgtgaaggaaccgacctgactgtagttacttatgggaatacgactcatttctgcctgaacgtagccgaacgtcttgctcaggaggggttgggcagtgtcgaagtcatcgatctccgttcgttgatcccattggataaagaggctatttttgcctctgtgcagaaaaccggtaaagtattggttgtacatgaagataaagtcttctccggtttcggtgctgagattgccgcgcagattgccgaagagatgttccgttatctggatgctccggtacagcgtattggctccacctttactccggtaggtttcaatccgatattggagcgtgccatcctgccggatgatgaaaagatatataaagcagccaaggagttgctggaattttaattaaaagcaagcaatcatgaaaaagataggaatattttatgctgccaaagctgataaaacctcttgggtagctgaaaagatacaaaaggaatttggtgcttccgccgagtctgtggctatcgaaaatgcctggcaaaacgattttgaggcttatgacaactttattgtcggagcttccacgtggttcgatggtgagttgcccacttattgggacgaactacttcccgaactccgtactcttcagttgaaagggaagaaagttgccatcttcggacttggcgaccaagtgaaatatcctgaaaactttgccgatggtattggtattcttgccgaagtatttgagaatgacggagccacacttgttggtttcacctctattgacggatatagtttcgaacgctcacggtctttgcgggatgacaagtggtgtggactggttattgatattgaaaatcagtcggaaatgactgataaacgaataaaagactggtgcaaacaggtaaaaaaagagtttgagagccaataaggacctttcaagagtaacaaagaactttattcagaggtaagctacgcaaatcccactaatttctttgatggatacaaaatcagaatatttgtgggatttgcgtttattgctatgtttcctgctcttttagatgattgagcacaggatgaatgttcaaaggaactttaattagagtacaaattttactgctgcccaccgattcttttcctgatggtgtacaaatataaatccgttcttttccgcttcctgtcggatgaccggaatatcatctacataaaatccgctcatatatagctccgatcccgggtgcatgcatgctgcatactgtttcatgtcattcagtaagatattccggttgatattggctattactacatcgaatggtccttttcctgccaaagccgaagcatctccctgagaaacggcaatatctgtcactccgttcagttcgatgttctctatcgaattacgtacacaccattcgtcaatatcgatggctgtacaaggttgagctccccgcatccgtgcaaggatggccaggattgaagttccgcatcccatatccagcaaggacttaccggttagctcactatctaacagttcaccgataatcaggctggttgtttcatggtgacccgtcccgaaagccatctgcggattgatcacgatgtcatattccactttgggcacgtcttgatggaatgtactatgaatcacacaacggtttccgatcacaatgggctgaaagaaattcttttcccactcttcgttccagtttttatcttcagcttcggtaaatacataagtaatttccgtatccggtatcgggaagtttgccagttcagttttcagcgtctcttcattatagagtgattgttgaatataagcagtcagtccgccttcccgttcgacaaaactttcaaatccggcctcacccaacacggcagccagtacatcattcaccgtttcggtgcaaggatgggtatcaaaagtgaactcaaagtacttcataagtgtttttttatttgcaaaagtacgatttaaagagatagaaacaaagtaaacattgtttttatcgggttgagatttgttaagttaaagaacggcaaaatagggaaatccctattattgtttggggaaaatctatccggtagcgtgaataccttgcttatctttgtaacgtgaataaaaagataaagtaaccaataaaccacggaaatatgaaaaagattgttttattatcgctgtttgccctgtgccttccactggctgtgatggcacaaagcaataatgacgacctttatttcgtgccttctaaggagaaaaagcaggaagcagaaaagactcctgtaaagaaggtaccggaaaaaaggacagtcaccacgaatatttatacggctccgggtactacggtagtggttcaggaccgtaaaggaaacaaacgcgatatgcgtgatgtggatgagtataaccgccgttacgatgctaaagataatgagttcgcaatggaggacgatacattatatgtaaaagaaaaagctatctccgatccggatggtgaatgggtgaacgggttcaatggctcacaggatgactacgagtatgccgagcgtatcattcgtttccgtaatcctcgttttgcggtgagcatcagcagtccgctttactgggacattgtttatggagctaattcttgggattggaatgtttatacagacggtttctatgcttatgcgttcccaacgtttaccaaccgcttgtggtgggattggcgttataactcttatggtcccggatggggctggggatggggctggtcttcaccttattacgcctggggaggctattatcccggttattggggtggctactggggtggttactggggcggctggtatggtggcggctactggggacaccatcatcactatcatcccggatggggtggcggaggaaattattgggcgagtcataatacttataccaaccgccgttcttatggttcttctcgtgttagcacctcttccagagtaaacgcctcttctatacggcgtacagattcttatactcgttcaggtaataatatctctccttcgcgtggcggtgatagccgtatgaattatggctcacgtagagtaataagtgttcgagatacagaacgtcctgatgcaacaacccgcacggatgcttcttcatcaagaagatctacttatactcgtccaagtagtacacgtagtagctctagttataatagtaacgttcatccgaatcgttctacaaactctggaacatattcaagaagtactagtaggtcttcttctacttatactcgtggaagttcgacaacaacaccttctcgttcttattcaaatgaaggtacccgtcgttcttatggctcttcttcatcttctcgaagctattcctcaggtagttctactcgctctagtagtagttattcttccggtagcagaagtagtggtagcagttctcgttcgacaagtggtggaggtagctacagcagaagtagcggtggtcgaagataagaaaattgtgaattgagattttaaaagaattaggatatgaaaaagataataatagtttctgcattagttcttttatggactgcaggagcaaatgctcaaactgcatatgatgctgcaaaattggttagcaaagatttaaatggaacagctcgttttgttggtatgggaggtgcaatgggagcattaggaggagatatatctactatggggacaaatccggctggcataggtatttatcgaagtaatgatgttatgacttcttttagtttttctacttatgggacggaaagtaaatatggtggaaagacatttgataataataataatcgatggtcttatgataacattggaattgtctttgcttctaaaataggtaatcacactccattacgttatgtaaattttgggtttaattatcatcgtgcaaaatctttctataaaaatatgtttatggagggcgctttgaattattcgcaaatcgattatatgactggacaagctaatgggatgttggccaatggcgtgagtcttaaggaactgtcagataataaattgaatccttatagtgataatggcgttggctggttaggtgctttaggctgggatgggcttttgttcgattttaagaatggtgagtatattggtgtcttgccacaaactccatattctacttttcgttcaagagaaaaagggggaattgatcagtatgattttaatatagcctttaatattagtgacagagtttatctgggactgacaattggagcttatgatgtagactatactaaatcatattactattcagaagattatggtgataaacagaactataatataggaagtatgaatcgcattagtggttccggttttgactttaagatgggagctattattcgtccgtttgaagattctccttttcggatcggtcttgcagtacatacacctactttttacagattgacgtatacaacaagtgcttatttggaatctaatatctggatgcataataatgatacagggaaagatgaacttcttaatagttattttgatacttataaggagttgaataataaagatatgaatcgggaatttcgtttaaaaactccctggaaatataatgtcagccttggatatactgttggacaaaatttagccatcggtgctgaatatgaatatgaagattattcttctgtgaagtttcgttatccagaaggtgataagatggaatttgagacgaatgcagcaaagatggttatgaagggagttaatacatttcgcattggtgccgaatataaagtaatccctcaatttgcttttcgtttaggatacaattatagttcatctatattcaagaatggtgctataaagtacttaccatataattctgttaatacagacactgattttgctaattctaaatcacttagcaattatactttaggtattggatatcgtgggactatgatttatgcagatctagcctataaattctcttcttataaagaagacttctatcctttctataatgagtttaatgatagaggcattgtaactcctaatgtaactaagataactaatacccgtagccaagtattatttactttaggtatgcgtttctaaataagatttccaagcaatttaaattataacttttgtgtgtatagaaatccctgaaggacgatgcagtgttcttcggggattcttgtttataaagatttaagtgagcataatgaacttattattagaaaatttgttttatgttaatatatgaactcactgatatccaattagaatttgtcttcattctaacgaagatattgtgatttatgtaattatgaatgcaagtgagtttattccttaatttaaataagtctttctcttttgagtagtgttattggaatatttaaattttaatttggaaaaatatggagagatgattttataaaaaccggttttacttggtatttcatttgaatagtcttttacactttttataatgtataatttaattgttttggagtatgaaaaaacttggacttttactaatgctattcacatttgccgcttgtactaatgatgatttttctgtattacaggaaaatgaagaaattaccttacccactgctgtaactagggcctctggagataaactatatgatttattaggttatggatatgatgtgacaggattatactttacttctgcttctgctaaaagtaaaataattgatatagttgcactgagaaaggattatgaggaaagggtcgatattggcgctgtgccttccaattatgctagaatgacttcgggtactacggcacaagactatactcgtaatgtaacttctaaagtaaaactcggaggagcattatctttattctcgggttctttgagtagttcttttagtagcactcaacattattcatcgaaatactctatagctgactatacctcttttattaggagacgtagactttttcttactgcttcgacagaattactatcgaaatatttgacaaagatgtttgttgatgatttatctaaacaatctccatcttttattatccaacattatggaacacatgtattaacagatattactttgggaggaaggataacaattctatatagaagcgctgttaacacatcaaagaaaacagcaaccgtagaagctggatgtgcatcgggtataaaaaatatgtttaatttgagtgttgatgggcattatgatcaaactttggttaaggataattcggagcaggaaattgtttacagaacagagggaggagatccgagtagggccttaatagggcaacttaattttgattctaaaaatccatctgtaattgatatatcatcatggcaacaaagttgtgatgataataatatgattttagttgatgcagagcctggaagtcttattccaatttatgatttggtatctgatacgggtaagaaagaacagttgaaacttgcagtagaaaattatttgaaggagcatagttatgtagacattgatgattctagtaagggaggagctgtgcgtaataattctcgggggcataataccagttcgtatggtaattcaactcgagttattggagctaatggaaatagaggtacttataggagaccatagtctctttaaattacacttttatacagggcttttctcttttttgaagtagaaataaccctgtataaagtccatttttatcagtactctatcttatcttctttcttcatccactcctcaaaagctttgattgcttcgtcgtgaagtaatatctcggatggtaacttcctgtcctcaggtttcagttccaattcatcgtagataaacgagtcgtcgaacccgatgtttttggcatctgtcttgttattgccataatacatcttgtctaatcgtgcccaatagatagcacccaggcacatgggacatggttcgcaagaggtgtaaatctcgtaaccgctcaggttaaaagttcccagttttgaggcggcagcacggatagcgcttacttctgcgtgagcggtgggatcgcacgaagctgttacgcggttaacacctgtggctactatttctccatcttttgcgataacggctccgaaagggcctcctccgtttgctacattttctttggaaagctcaatcgctttccgcattagttcttttttggtcatgtgatataaaaaaatctatcgttgatattgttatatgttttttgcaaatataaacaattagaacgatagattgttccttcaagttaagaaatcggcctattctttatggattgacaggttactttcatctgccgggatgcggcggctgaccgctgggggctattgttaccaataccagcagaggccgaaagaataaggataaagttcgggtcctttcttgtgttcgaagaggctgtaggtagaatagcgcaaataaactccgatatcgccataacctgcctgtgccaaaaggttgatacctatcggatgaacattcaggttattgcttaaattttctttatgtccgtttactttcgcctttgacttaaccccgtggcggatttctgcctcaagtccagctgagaagaataaaggaccgtgtccgttactgtggctaaattttttttgccattccaatgttaccggaatacggaaatagaaatagcgtaaccggcttttgctgtaaacttcttcatctggaatccctggaacaatgtttgtgattccatcggtttgtctgaaagcgtagttgccacccagacggaaggagcgatatccccagcctaagcctgtcgttatgccccattggcgatcacgtgagagcgtcagggaaccttgaaacaggttaaaaccaatttcccaagacttatttgcattgacgtccaatccgttcggagtgttgaaattgataccgtcagagagccgtgtgtatcccatatagatcccggcaatatgcggttcaaaccgataatagttctttctcttgacaaaaggcatggtgaatgctgtgcggcgttcggttgtttgtccgtccgtatagattccttcgaatatctgatcgttctctatcgtatcaccgcgcgaagactgttcgtaaagttttacctttattttcccctctttttctttaatcaggattttgcgtccgtttacgtaaagagtcgtgtcttgcgaaatgctttcttgagccattcccgccatcgggatcagcataaacagtaataaataaatgtgtttcatactcttataatgtttagtttttcttcataaataacatggttaccaaatcatctgcatccaactcgccttcgatgtaaatcaaggtagccgagcctttcttgccggttttgaagaggatgaaccggttgacatcttcttttagttggggcaactgataatagccggactgtatttgtccgcctgctactacttcctttactttcctggcctttctcttgtcggcttccaggcagttgagaatatcgggcaaagcttcttcgacgtctttaaaaacaaggcttttatagagagtcatctgataggtttccagcatctcattggataactctaccatagtcactcctttctgtttgccgtatttctggaatacggaagctatttgcagtccctgttgtgctcttaccatgcccgaggcaacggtgagcagcaggacaatccatgtggtgcgaatgactttattcatacatcgtttcttttattgttttctttttttattcggagaatagcgtggcaaacacttcctcttcgctgatactgacatcacggaatgcgaccatggcctgttcgcgcaccagtcgggtgtcggtatagcattttccgtcgatgattacataatttccggtagaggtgctgaaatgttggttgaggccggcgatacccagcacaatcaacattccggcagccattccgctgaatatgtatagcagacggcggcgcagaggaacggaagttttcggaacttcggagccggcaatcttgctttgccggttctcttcgctgaagaaagcaaacatcggaccatacatctgcagatgttccggtacgatgccctgagtgaaaaaacggcggagctcacgttcttcctcacagttggtttccccttcaaaatacttgttcaataattcttctatattcatgcttcgtttctcctttttctttgttgtatggtttgtaggtaaatgtctctcactttcttccgtgccctgcttaggttgctgcgaatggcttcggcaccgcatcctgttatttcggcgatttcctcgttttcatactcttcaacatctttcatcctcaggatagtttgttgcagaggtggtagcgtgccgattatttcgcgcatcagacggaattcgtctttctcttccagtaagcgttcgggggtggcagacggactggcagcttgtatgctgtcgagcgataaattgtctgtatgttttccccgccagatgtccatacaggtatggtgcgtcatagtcatggcaagtgcttcaatgctgtggtactcgtccagtttcaggcggaggttccatagtttcagcattacttcttgcacggcatcttcagcatccgaacggtcatcggtcaacttccgcgcataattaagtaatttgtcgcggagtggaagaacggctattttgaattgttttagttccatttacataagcaagacggaagaggaaggaaaacgtgacatggaaaagataaaaaaacgatgaactaattatccacgctgaacgatcaatgatgaatggtgctttaatagaccgaaggcataaggaaaaaaacaatctctattgttcatcagtcattgttcaccgttgatcgttcagcgtggatgattcattcatcgttcaaaacgtttatcgtttagagctttccaagtattttatccatgacccaattggtagttgtggcactttcgccgtcacaggaacaagtcgattttccaagaagatggtctaccacggcttgaatcaaaggctgctgcacgtgttcggggtttgctacaactatttcttcacgtcctctttcggtgtgaagggcaatcgggtcataggtgaatacggagaaacagatcataccattatcaccgataatctcaatgcggtcttcgcgagccgaatcatgggcaacgaagcaccatgaaccgcttcctaccagaccgttgtcgaactggaaacaagcactcaatgtatcttctgctggataaagtcccccacggttactcttatatccgctggcttcaagaatacaaccgaacatttcctgtagaagatcgatctggtggggggcaaggtcataaaaatatcctcctccggcaatgtctgcctgtacacgccaaggcaggttctctctgttgtaatccaggtcgcgtgggggttgagcgaaacggatctgcacgttaatcacatttccgataattcctttgtctaccagttccttgactttcataaagtaaggcagataacgtcggtagtaagctacaaagcaaggcactcctgtctcttgagaaatacggttgatacgggcgcattcttcgtaagtttgtgccattggcttttcgatatataccggttttccggctttcatggacatgatggcataagtggcgtgtgaagagggaggagtggctatgtatacggcatttacatccgggtcgtcaatcagctcctgtgcatcgtcataccacttcggaatgttccgttctttggcataagctttggccttattgccgtcacgactcatgactgctatgactttggaaccttctactttctgaaaggcaggtccgcttttgtatttggttacttctccgcaaccaatgaatccccattttataatcttatcgctcatatcttttttatttatccatccgcaaatatactcaattctgctgaaagcgacgaatgatttacagttatcataatagagactctctgtgcccgtttcttagttcacattctctggttgtacaactccgtatgctaccagttgcgcaactggtaatcgtagtctttaaatgaattggaaagaaggggagggagttgttactgctttccgtagtatttacgatagatggtctgatattcacctttctttcggaagccggacagccatgtattcaggctgtcgagcagagcaggggactgcttgctgactccccacgagtaaaattgggtgaaactgatggcggtattaatatcgagttgaggcaatgaatctacggccatccgggctatactctcgtcgcatacggcaaaatcgatatctccatgcgcaaccattgcgatcagttgttcggaaccatattttgctacttcgtttacgtagattgtatcacctatttcattgctgaggttgtgtatccgaagaatagatggagaaccttttacgacgttcagtgttttgccggccaggtcgagttggcttctgatggcaagcgagtcgttttcttcggctttgcgttgcaccaggacttgtttgctcaagataatgggtgaggtgaggagcagggagtctttcagttcacttgttgtcggtataccataagctactacgtcataggtgccattagccaatccttccagccgttgattgaagctcatcaccggggagacctgtacttgcaagcccttgtcacgggcaaatgcctctatcagttcataatgaaatcccgaaacggtatctccatccacataaaaactgatggagttatattccgtggcggcatggaggatgccgctttcttcgatctctgcgtagttgcgcggatgtccttgcggcttctctttacaaggccagaatgtgacaacgagggctgatatcagtcctaatactacatatttcagatatttaggcttcaatagattcatggtagcgattaatcgtagaagttccaggaaacaccgatcttaaacaggcgcggattgatgggatagtggggcgacaggaagtaattcgagttacccattccctgattgacgtgatacatcattgcgaaaagacgcgtgcgtttcagttgcaggttggcatatacattgatgatggggtaaccgccaatctttacctgatcgtcttccggttgcagatgaaactgctggatggccggggtatatgccggggcataatacttggtaaaatagcgtacatcggctcccaactgcacatgaagcacttttttcgccaaggttgtctggatgtagaaattatggtaaagtgaaagctccggtaagggcaatacggtagtgttgctcgacttttgccaggtcacttcattgtccagatggaaaatacccaatcggaaattctgcgacagagtggcggaaagcacctgaatattaccgtcattctgctgagggagtgccttttgattgaagtacgtatagtttttaatattttctactccggctttcaggtgggtctgccaatgctcgatgttcagctcgccttccaggcgtgtgcggaactctttgtccatattgtcattatcccagtagaagtatttagaatgataatgacgcatataaaatgccggaagggtattactaattgatccgcgggcaataaagctgaccgtatctttccataagcggaagttcaggtcgagatcggcattgacacggaactgcccaatcgctttatccagaatacctacttcgcccatggcacggtaatggagcgtttttccctgacgtttggccaattcacccccgacaaaaacttcgtgttcactgtatttatctacactcacggagtctctgtccattagccggtaattgcttagcttatgtgagataaaggcagtcaatccggctttggcatatttattaaaaccttcaagcagagcgattcccaatgtattttttactccgatatagctggtagagtcattcaccagcttattgcccggctggatatacgcttccgggtagattttgtacaattcgtcctcggaagtgaactggtggcgggcacgttccactttcattgtatggatgaagctggtaaccggaacaaattccgtcttttccgtactggtggtatcgtctttggctttggccacttcacgagtgaatcccagtttgtaacgttgggtgaggaatatgtaaaagtccttgttacgattggcacttttgcttaacagggtgggaatgttctgtgattcatattccttttttccctctgccatttcttccgggcgggtgatgtaacggtcatcggtgataccgccgttttcattcatctttagatagttgttgctataaagcaatgtcgcttcgtagcggtcgcctatataacttccgaagagtgcggcattaaagaaagaagtgttttgattgttgtaataacctcgtccgtacagataatcgaagttgaaaccaaatgccagttgtttgtttacatttactgagaaataggacttaaatcgctcctctccgttcactttattaccggctttataatagctaagattggtgaaaggcacgttactgttagtaaagttgaattcgtcaggacggacaaaaaaactggagaatggctccataaaaatggtcggttctgcgtcacggcgttcgaaaaagagacgtgacaggcggggagaacctaagttacccagataattataatgccctctcaggccttccactaaattggtgttttgaaacatgtgggttgccgtatcagcgggtattttctggattgttcccaggttttcgctgacatgccacatatagagttttgggggaagtccttgtatttcaacgtctgtactgtcctcatgcacccgcatggccgggtctatctggttaccgttggcatctctaccggtacggggatcgacttgttgtgtaggattgaactgtgcctgtgcggtcagtaaacctacgacaaggagtatatatgtaagtaggattcgtctcataattagccgcaaagatacttattaaaatgagaattgagaattgaattttaaaaattatccggtttcccaggctgtagcatagctaataatttttaaatttcgattctcaattctcagtcggcttaaacctctctgatcagttccataccttttttgatggcttcttcattcatcggaatcaagtgatggtgacgttcgggtaatgtttttttcagacctttcactacattctctaatgtaacgatggggcgaagcttcagtaatcctcccagtacaatcatgttgaatgctttggcattgttcatctcgttggccgcatccattgcatcgatgcggtatactttgatgtctttgcgggtaggagggttaatgattccgtatccgtcataaatcaggataccacctggctttacacggctttcgaacttttcaagtgaaggctgattcagaatgatggctgtgtcatatttactcaaaatcggtgaggatattttgtcgtcgcttacaatgactgtaacgttggctgtaccgccacgttgttcaggaccataagccggcatccaggtcacttctttgccttccatcagtccggagtaagctaaaatctttcccatagacagcacaccctgtccaccgaatcctgctataattatttcttctttcatcttaataatattaaattattatttatctttcaggtcgcccaaaggatagaatggaaacatgtgttcttccatccatttgttggctttctccggagtcattttccatccggagctacaggttgaaacgatttctaccaagttggaaccttttccgttcattgagttctcgaatgctttacgaatcgcttttttagcttttcggatggcgggaactgtttgtaccgattggcgggttacgtaagctgtaccttccagttgagcagcgatttcagtaatcttcagcggatagccgtggagttccggatcacgtccataagggcaggtagccgtcttcattcccatcagggttgtaggagccatttgtcctccggtcataccgtagatggcgttgttgatgaagacaatcgtaatattttcaccacgattcagtgcatggatggtttctgccgtaccgatgcaggcaaggtcgccgtctccctggtaagtaaataccaagcggtcgggccagaggcgcttaatggctgtagcaagtgcgggtgcacgtccatgggcagcctcttgccagtcgatgtcaaggtaattatatatgaatacagcgcaacctacaggtgagataccgacagctttgtcttccaatcccatctcttcaattacttcggcaatcagtttatgtaccacgccgtggctgcaacccgggcaatagtgcataccattgtcattcatcagagtcggttttttataaaccagattctcgggcttgattatttcttctttcgtcataacttctttttttaatctttaaatcactgaacttatggttttaagttcggaggtttgaagtctcacggacttgaaaacacaaaaactcagaaacttatctgttggtgaaccgtataaaaaactccatcagcttgacaaagattgccgcgccgcatacgtagataaacaccttaaagtcatccttcgctacgaagtaggtgatgatagctgccagagccaatatcataaacagtatgttcaatacgtttcttattttatcgggattcatcgtactgtagttatttgattaattgttctttcaatgcagttactatttcgtccgggtcgggaacaatgcctcccaggcggccgaaatgttctactttcacttttccgtttaccgctaagcggacgtcttctaccatctgtccggcattcagctcggttaccagcataccttttactttattggcatactcggcaattgctttcgtcgggaacggccataaagtgatgggacgaagcataccgactttaatgccttcttcacgtgccaactccatggctttctgaccgatacgtgccattgagccaaaagctacaatcagatattctgcgtcttcgcagtcaatttcttcaaaacgtacttcgttttcttcaattactctgtactttgcctggaagcggaggttgtttttctccatctcttccggacgcagttccaacgaagtgatgatgttgggcttacggtcttttgtttttccggtagaagcccatggacattgtgctatgacttccgcatccgtacggcgggcttttgcgggaggaagaaccactttctccatcatttgtccgataacaccgtctgcaaggatgatggccggattacggtatttgaacgcaagttcgaaagcgagtccgacaaagtctgccatttcctgaacagaagccggagccaatgcgatgagtttatagtcaccgtgtcctccaccttttacagtttggaaatagtctgcctggctgggctggatggtacccaaaccggggccgccgcgcattacgtttacgatcagacatggaagttcggcacctgccagataagagatgccttcctgtttcaggctgacaccgggacttgatgatgaggtcatcaccattttgccgcttccggcaccgccataaaccatattgatagctgccacttcactttccgcctgaaggactaccataccggtagtttcccaaggtctcagttcggcaagagtttccaacacctccgattgcggagtaataggatatccgaagtatccgtcggcaccacagcggatggccgcatgggcgatggcttcgtttcctttcattaatacaacttcttctgccatattcttttcttttattctactttaattttataaacagagatacatccgtccgggcatacagttgcgcatgaactgcatccgttacaggtatcttcaagaatctgctgggcataattatacccttttacattcacctctttggcgagggatattacgttgagcggacaagctaccacacacaggttgcaccccttgcaacgctccgtgtcgactacgattgctcctttgatttttgccataatctgtctttattacgtttattgattatacatatctttattgtagaaatttaaaatatccatcaccatcttgcgtgcctggagagccgggctgtcgggattgagttcgatggcggactggtaattgttgagagctttttgccagtctcccaatttgcggtaagcatttcccatcagatagtaagcttcatcttttccggctggttcagtccggagaaattcgtcaagtgcctgaagcgccttttctatatctccttggttgataagctctttgatggttttcagttgatccatatcttttgattttccggattattgagtcacaaagatagctttttatcctttaacctgttcatctctattgtgaaaaataggaaaactgaaaaaaatagagatctgagtatagtatgcctctttgtcaatctgatactcttttgatgtgtttgtaggtatttgtagctcctactgtttacaattctttgattatatcagacttttgaagaattatgttttttatatcttaatgtgcttaatttaaggtattcttatcacttggtaatcaatgaacttcttcttccgggaaatgtattacgggagttttatccggaaggtgctttgaaaagcgaagcggagattaaagaaggaaaacgtcatggtcgttaccgtgaatattacgaaaatggtaaactgaaattccgtgggaagtatgcaaataatcaacctaaaggtacgtggaaatactatactgaagaaggtgagtttgaacgtaaggagaagcactgatagagaagtatgccggattgcctgtaaatagaagagggtgtgtcgaaactcttttcaccacggagtaagacagagtaacacagagatgattttaagttgttgattattagcaaaaaaaagactctgtgctactctgtcttactccgtggtgaaaagagtttcgacacagcctcgtattattataagaattggcgttctactgatatgagaccgtatggttttactttaccgggatcttatcaatacgtttttgatggcgtccgccctcaaattcagtcgagaagaactccgtcataatcatgtccgcttcttcggtactgatataacggccgggcatgaccagtacgtttgcatcgttgtgcaggcgtgccatgtgtgcaatttctgctgaccagcaaagtgccgcacgtataccttgatgtttgttaagtgtcatactgataccgtttccactgccacaaatggcaattcccggatagcattcaccggcttctacagccagagccagcgggtgggcaaagtcgggatagtcacagctgtctgtcgagtatgttccaaagtctttgtattcccagccttttgcttccagccaacctcttacatattcttttaattcaaaaccggcatggtcgcaacaaattccaattttcttcatttttctttaatgtgctaatatagtgaatgtgctaatgccccagtccggaagaactggcacattagcacattgaatgattgatcagagcattgattttacctgattgtatacgttttctgctgtgaatccaagcttttcatccagtactttgtatggtgcggagaaaccgaaggactcaagaccgaatactttaccgttggaacctaccagaccttcaagattcaccggtagtccggctgtcagaccaaatactttggcacctgcagggagtatcgattcctgatattctttactttgattgcggaacaatccttcggacggagcagaaacgatgcggacttttacaccttctttgcgcagaagttcggcaccggcaaccagtgtggaaacttccgatcccgaagctaccaggattacatctggattttcatcggcatctgcaatgatgtaagcacctttagcagcctgtgaataatcggttcctacgggcaggttaacgatgttctggcgtgaaaggatcagtgctgtaggagtcgacatattttccatggcgagcttccacgcaattgttgtttcttctacatctgccggacggagtaccaacatcgagttgtgtcctttatggtttttcagcttttcaagcagacgtacttgtgcttcttgctctaccggttcgtgagtaggtccgtcttctccgacacggaatgcatcgtgagtccagataaacttcaccggttgctccatcagggcagccatgcgaagagccggtttcatatagtccgagaagacaaaaaatgtaccgcatgcagcaataatacctccgtgcagagacataccgatgcagatgcaagccatactcaactcagaaactcctgcttgcaggaaggcaccgctgaagtcgccttttttgaatgcatgggtctttttcaggaaaccgtctgttttgtctgaattagacaagtcagccgaagacacgatcatattttctacctgagtggccaatgcacctaatacggttgcagatccggcacgggttgctccgcctgctttctgttctatggcatcccaatttactttcggggcttttcctgagaagaactctgtcaatttagcggccagttcgggattcgcctttgcccattctgctttggctgcatattttccggcaacaattttcttcagctcttccgcgcgttttgcgtacagttcggccacttcggggaatatagtgaatggagcttccggatttccacccagattcttgattgtatttacatatgcgtcaccgcctaacggtgcaccgtgtgttgcacaatcggcttcataactggttccatctgcccggcgtgctcctttacccatggtggttttaccgatgatcagggtcggacggctcttctcagctttggcttcaatcaaagctttacgtatttcgtccgggtcattgccgttgattgtgattactttccagtcccatgcttcatatttcatggctacgttttcggttgtcacatcttctgtgttggtagaaagctgtacgtcgtttgaatcgtagaacataatcaggttgtccagtccaagtgtaccggctatacggcctgcaccttgggaaatttcttcctggatacctccgtcagatatgtatgcgtagatagtctggttcattatttcgccgaagcgggctttcaggaattttgctgcaatggctgcacctactgcataagtatgtccttgtcccagcgggccggaagtgttttcaacgccacggtctacattcacttcagggtgtcccggagtagggctgccccactgacggaattgctttaattcgtccaatgtatattttccggtgaaagccaatacggaataaagcatcggtgacatgtgtcccgggtcgaggaaaaagcggtcgcgaccttcccaacgtggattttgcggatcgtataccaaaaactcagagaagagtacgttcacaaaatcagcaccgcccatggcgcctcccgggtgtcccgaattggctttttctaccatcgacgcagctaatatgcggatattatcagccgcacgattcataagtttactatcgttcatatctattgattaatttagttttttcagatttttcgcaaagataaccttttagtgggatttatctaccataaaaagatagcttttttacataacaaaaagaaaggcacatctgtttaggatgtgccttgccttctgaatattagtttttaaatctttatgccagttttcttgaaccgtcactgataactacatcatacactttcgggcttctgccgaatttagctttaaatgattctttggctttttcgatgaagttgtcatacaattcgtcttttaccaggttaatggtgcaaccaccgaaaccgccacccattacacgtgagccggttacgccacattctttagcgcagtcgttcaagaagtcaagctcttcgcagcttacctcgtaaagtttgctcatgccatggtgagtttcatacattttcttgcctacggtttcgtaatctcctttttccagagcatcacatacatcgagtacgcgttggatttcttcgattacatattcggcacgcatataatcttctgcactgatatcagcttttgcttctgccagcatatccattgtacagtcacgcaggaattctacatgaggatgttttttctggatagcagctacggcagcttcacagctctgacggcgtttgttgtatgctgatgaagccagttcatgttttacaaccgaatcaagcaataccagacgataaccttccggtttgaacgggaagtactggtactccagagaacggcagtccaagcggatcaggctgccttcttttccgaatacagaagcaaactggtccataataccacagtttacaccacaatagttgtgttctgtagcctgtcctattttggctaattcaaacttgtctattttattctcaccgaacagatcattcagtgcgaaagcataagtactttccaaagctgctgaagaggacatacccgcacccagaggcacatctccggaaaaagctgtattgaatccttttacatcaacaccacgtttgatcatttcacggcatacgccgaatatatatcttgcccaactggcgcgcggagcatcttcttcgttcaatccgaaagtaacataatcttttaggtcgatagaataagcatttactttgtctgtgccatttggcttgatttcggcaatcattcctttatcgatagctcccgggaaaacaaatccgccattgtagtcggtatgttcgccaatgagattgatacggcccggagaggcatatacaaatcctgtagttccatcaaaatgtttgatgaagcgacttcttacgtgttctatatccatgatcgttttggtattaaaagttattatttatgtttttattcaacaggaatatccttatttacattcttgcaacctacaagtgcataatacagcatgtatgctacagctgcgaagattacccagtaacttgcaatataactgctggttacatcggctacagcgccctggatcagcgggagaataccaccaccgcaaaccattaccatgaagataccggaagccattgctgtgtatttacccaatccttctactgccagattgaagataccaccccacatgatagaagtacagagtccgcaaagtgcgaagaacatgattcctacaggtactgtttccataccgaagccgatgctggcacctcctttaaatacaggcatagctactgttgttgcactgggggcaaacataccgatcagcaagaagatcagagccagtgaagaaactactgtcaactgagttttacttgagaacttagctcccaaagcacctccacacagacggccgatcatcattaggaaccaataggtgcctacgattgaacctgccatagctgtatccataccgaatcctttggcacctgccgcatccggtgaagtggtcaggaacaggttaataaagttaggaatacctacttccacacctacatatacgaaaatagcaactgttccgagaacgaagtggcggaatgaaagcgggctgtgagtgtcttttactttatgatcgcttgcactttctttgtgaggctcgggaatgtccatgatggccaatacgatgaatacgacagcgaagatacccatagcgatgaacaatgcagggttagcatcactgatacgtgtatcctggctgatggtaccgatcagataaccacccaataccggaacgatcgtagcagaaatagaattcagagaaccaccgaactggatcaattgattaccctttttaccaccacctgcaagtgtattcaacagcgggtttactaccgcattcaacatacacattgagaaacctgaaacaaaagcaccggtcagataaacccagaatacagtcagttctcccggctgatagtccatctgtcccgatagcacttgaatgcctactccgataaatcctacggctacggcagtaagggcagtctttttgtaaccgattcttttgagcatcatacctgccggcagtcccataaaggcataagctatgaagttggctgcattacccagctgcgtcatccagttggcagcctggaattgctcttttacaataagtccgagcggattagtaagtcctgttacaaatgaaatcattgcgaaaagcgcaaacatcattgcaataggcaacacataattcttttttgttgtgtcatggtttttaaaaagttgttagttataaaaatgaggttagttatttccttatttatttttcaactccgaatttatagatagttacctgctggtattcatcacccggcagtaacgtagctgacgggaaatgtgctttgttcggtgtatcggggaagcattgcgcttcgaaacagattgcacttcgtgctgggaaggttgctccgtttgtcccttcgaaacctcccagccagttacctgtatatagttgtacgcctgcttctgtggtgtatacttccatagtacgtccgctgttaggctctttgcaggtagctgccaggtccagagaacccgcttctattttgtttagtacatagcaatggtcataacctgcaccatgtatcaattgctggaatttatcattaattcgttcaccgacggtgtgcggggtacggaagtccattggagtgccttctactttggctatttctcctgttggaatggatacctcatctatcggagtatagaaatctgcgttgattgtgacgatgttgttttctactgttggggtgggattggcagtacctgccagattaaagaatccgtggttggtcaggtttacgacagtcgctttgtcggtagtagcacggtattcgatgacaattgcattctcttcttcttcaaggcgataaatcatttccacttccagattaccggggaagccctcttctccgtctgccgaagtatagttaaaccggatcatgccttcctctatctgttcggcatcccaaactctggcatgaaatcctgtggggccgccatgaagtgaattagggccattgttgattgtgagattgtgctcttcaccatacaaggtaaatttacctttggcgatacggttgccataacgtccgatagtggtgctcaggaaaggttccggtccgtgcatcagtgcatccagtgtgccgtagctgagtacgacgttggcatattttccgtctttgtccggaaccatgatagatagaatggcgcatccgtagtttgttacggcaacttccattcctttcttgtttttgaggataaacaaatcggttttcttatcgtttatatccttttgaaaatctttccggctgagccctgacagatttccttcagttgggaatgtgttaatcatgtctggtattattaaaatttcttgcaaataaagggaaattctttcgttctcccaaattattccttgtaaatctgttcggcgatttaggaaagtttagcgtttcccgaaaaagcatccaaaattgtaatgtgaagataaaattttcatgttacttttaattaaaaggcaggattttgtgtattatttgatatttttcgtatgtttgtcccttgattgttaaaatcatgagtttttaatctaagtttataacaagaaaaacaaaaatgtatccgttaaaattcgaacccattctgaagcagacgctttgggggggcgacaaaattatcccgttcaagcatctgaaagatgatttgaagggagtgggggaaagctgggaaatttccggcgtagaaaataacgagtctgtcgtagctaatggtccagacaaaggccttacgctgaccgatatggtgaaaaaataccgtgaggaactggtaggcgaagcaaactatgcccgttttggcaatgagtttcctttgctgataaagtttatcgatgcgaagcaagatctgtctatacaggtgcatccaactgatgaactggctaagaagcgccacaactcaaaaggtaaaactgagatgtggtatgtagtaggtgccgataaaggggctaaactgcgttcgggattttctgagcagattactccgaaagaatataaagagcgcgtgtacaataatacaatcacagatgtgcttcaggaatacgaaatccatccgggcgatgttttctttttgcctgcgggacgtatccatagcattggtgcgggggcattcatcgctgaaatccagcagacctcggatattacttatcgtatttatgatttcaatcgtaaagatgcgaatggaaaaacacgtgagttgcataccagccaggcactcgatgcaatcaactatgaagtgcttgatgactatcgtaccaaatatgaacctctgaaagatgaaccggttgagttggtggcttgtccttactttaccacgtcggtttatgacatgagtgagcagatcagttgtgattattcagagctggattcatttgttatcttcatttgtatagaaggttcttgtctgatgaccgataatgaaggcaacgaggtgacacttggtgcgggagaaacgattttgcttcctgccaccactcaggatgtgacgattgttccacaaggcggcaatgtgaaattactggaaacgtacgtgtaaagacttccttgatatcacatgataatagtagacgcccggatatacaatgatgtatgtccgggtgtttttttaatatcttttccggaaaagtccgcgaactttgcggatcattttcatgcccagcatgacgccgtcaaaaatagccataccggtattgaaagaacgcatcagtgagctaccacttgaagctgcaggtgcaaggggggcgaaaatccggcgggtagtatccgccatggcttgtttctggttgcggatatcctgcaatatttcttgtttacgctgagcaatgtcttccagcgtaatttttttgggagtaggtgtgctgttgttcattgcttcattttttatcgggatcgttgagaaacaggtttgcaaggaaatttaccattggtgaaatgataagttgcctgcgaaaaaaataaatgatggcgatcaatatgatattgatgcctgctatgatgccgaaacttaccatcaatccacctactaatggttcaagaatgtaagccaaggcaaaaagcagataaaacagggctaccatacctaagatagtaagcactaaaatcataattaacgtggataggagtatcgttaatttttccgtcaattccagtttggtatactctttttggagcacaagaaacttcttgaactcagcaaacagttgctggatattttcaatgcttttatcgtctgtaaacatgatagctctgttttggtcttgttcatttagtcaattacttcacctttgatttcggctgcaatttcgtcaacgagattttccatttcgttacgattcaacttgataccttttttgcgaagaatctctgcgattttgtgacgagtatcttctcctttttcaggagcaaataaaatacccagggctgcgcctacggctgcaccacccagaaaagctgctaatacattaagtcctttcataatcttttgtttttaaatgatcatattacaaagctaacatttttattgaaaacttgttctatttgccctaatttttttagaaaataatactctgtttaaaatctgaagcccctaaagcgggagattcacttctttgtgggaatattcgtatgggagatatatttaatcaataaagagtgtgtgtcaaaactcaccacagaggacacagagtaacacggaggcgatttaaagttgttgattattaacaaaatactctgtgatactctgtggcactccgtggtaaaaagagttatgacgcaccttctttatacttttatatggagtgttttcttggagttataaatctccaagatttttctcataccatggggctgtgtatatggcgcttttgggttctatttaccattggcttgatttatatattttgatgtgaaagaaaatcacatctgccctattgccaacggattatttccttttttcttgcttattagaagaaggctggttaggcttttgttttttccgtctccagaagtcaccgttcgcccggcttccacggtatactttgttggcttttgctttgaccttaatctcttcttgtttttcttcctgagctttggcgccttcggcagtgacaaacggatgttctttcactacaggaatgtttttccctatcagtttttgaatgtctttcaggtagggaagttcttctgattcgcagaaagagatggctacaccttcatgtccggcacgtcctgtccgtccgatgcgatgcacataagtttccggtacattgggtaactcataattgatcacgtgcgatagctgatctacgtcgatgcctcgtgcggcgatatcggttgctatcaaggcgcgtagggtgtgattcttgaagttggtcaaggcccgttggcgggcattctgggttttgttgccgtgaatcgcttctgcgccgatgccggctttggtcaatatacgtgccagtttatcagctccgtatttggtgcgtgtgaaaataagtaccgactcgatagaggcgtctttcagcaagtgaatcagcaggtcttttttttcttttttctcgacaaaataaacttgttgagagatgatatccacagtcgaagaagccggggttacctccactttttccggttttgtcaacatcgagtttgccagtgtctctatttccggtggcatggtagccgagaagaacagagtctgtcttttcgtcggaagcagtttcagaatgcgtttgatatcatggataaatcccatgtcgagcattcggtctgcttcgtccaaaacaaaaaagtcaagtgaattcaaggaaacgaatccttgtgatatcaaatccaataatctgcccggagttgcaaccaatatctgtatccccccccgtaaagcgtcggtctgtggtttctgtcctactccgccgaaaataacggcatgtttcagaccggtgtaacggccatatgcttcaaaactttcaccaatctgtatcgcaagttcccgggttggtgtcagcactaatgctttgatccctttgcgatggtccgttttatacaatttttgcaagatagggatagaaaaagccgccgttttaccggtgcctgtctgagcgcaacctaatagatcttttccttgaagtaaaatggggattgactgttcttgtatcggggtgggagaggtgtaaccctcttgtcttaaagcctttaaaataggctctatcaaattcaaattttcaaatgtcatgtacaataattgaatgagcctctcggctctgttatgttatatagcacaaagataggtcaatagtaagacgtaaatccttttttctgtaatgctttaatcttatttaactaaggtgtagggcatatcatcggaggtttaagcgtacttttgtgtctcattatatgggaaatctaaattaatatatgagaaatgaaaggtaaaatcgtttttataacaggagcaagcagcggtattggtgaaggctgtgcacgtaagtttgcttcacagggttcggacttgatcttgaatgcccgtaatgtggcaaagctggaagaactgaaaaaggaactggaaactaaatatggggtgcgtgtctgtttgttgccgtttgatgtacgtgaccgcaaagcggcttccgcagcattggcctctttaccggaagagtggaaaaatatcgatgtgttggtgaataacgccggtcttgtgattggagtggacaaagagtttgaaggaaatttggacgaatgggatattatgattgataccaatattaaggcattgttggctatcacgcgtatggtggttcccggaatggtggagcgtagccgcggacatattattaatatcggttcgatagccggtgatgcagcctatcccggtggaagtgtgtattgcgctactaaggctgccgtcaaagcactttcggacggtctgcggatcgatttggtagatactcccctgcgggttacgaatataaaaccgggaatggtggaaactaattttacggtcgtccgttatcgtggagataaagatgctgccgatgctttttataagggcattcgtccgctgaccggagatgacattgctgaaaccgtttattatgctgcttctgcccccgagcatatacagatagccgaggtattggtgatgcccacttatcaggccaccggtacgatttcttataagaaaaaggattgctgagatttctgaaaaggtgttttttaggaagattgttttgtggggtgataaaaattctattattttgtccccttcaaacagtggatacgaaattattaactaaatgtgtatagattatgaaaaaattagtagtattagggatgggcgtatgcgttgccttggcatttgcttcatgtaaatccagcgaaagcgcttataaaaaggcgtacgagaaagctaaacaacaggaattggctgaaccgcaggtagaagctcccgtagaggtcactccggtggttactgctccggtagaaactaaaaaagctgttgataatgctgcaggcgttcgtcaggaaaaggtaacagtggtttcaggtgccgatggattgaaagattatagcgtagtatgcggtagttttggtttgaaagcaaatgcagaaggtctgaaagattttttggataaagaaggttataatgcaactattgcttttaatgctgaaacagccatgtatcgtgtgattgtaaatacatttgccgatagagcttctgctgcacaggcacgtgatgctttcaaggctaaatatcctaatagaaaagacttccagggtgcctggttgttatatagaatctattaataaagaaattctttttggtaatttcgggagcaacagatgtttgctcccggataaaggcagtaactgtgaagttactgcctttttcaaatagtgatgtgattatttcttttcgccgaactcctcctgttgttgttctacttctttcagtttttcggcattcttagctttctgcaatctttctttttccagttgtgtttctgactttagagttagactgtttgttccttgtccggtaaaggtcggaataaatgcagattcttcctgactgtaaatttgagggaaggttcccggtttactttctaattctaatacggcactacttggcatttgtgacccttcgaataaaacactggccgtgattttgattttgccgggttttaaagtagattgaatcagtaccggagccgttccccaacgaacagatgccgggttagccaagttatttgcgccgcctaagatacgtccttcaccttctacctgaaatttgatggtatagttattcaaacgtttgatattaccattcttgtcggcaacggcagctataacagtgataaagtcagaaccatctgccttcagatctactccttcattatctatccataagagtagtttttccggtcgtcgtgccggataaactttatgcgtagctactactttgccgtctatcagcccttctgccaataagtatacgtcggcctgtttgccctggcgtgacaatgctttgtcttgcataaagtcgtatgcgtctttgaaagtaatgatggggtaaggcatcccttctttctccggggtgcggacataggtttgtgtttttccacctttgagataagtaagtctcacttcgtcgcagttagaatagactgtgacatctttaccggagaacggggtcatttcatgggcgatataaaccatcggacctgtcttgaaaagacgcttctctttccggggagatcgttgggacataaacatatagtaagaatacttgggttgtcggaatacatccataacacctccgtagaacggatcggggtgataaccgcgttgatggtcgaacgaatgccataaacagcctcctacatgttgtcggggagtgcggtataaggcatcatagctggtatatttataaggtgggcaagcataatgttgcgcttgtataagcatggcttgttcaccccagttgcgtgccacccggctgggagagttgtgagaattccagtcatctacattatcaccccattcacgtgtgaagtaagtgatctgtttcttgatatggttggttgagtaggctcctccgcctccattgagcggatgggtgaaaagtatttggaaatgctcttttcctttggcttcactatcacatccgctgtaacaatatggatacggatactctgcttttactatatcatgtgcattctgggcaaagtcggccgggtaccaggtttcgttcaggattggttcccacatccatacgcagggatggttacggtcccgtcgaaccatattccggatgtcactgtatacccgttgcgcaaagacaggggcatcgttccagaattgccaacccggtgtattgacaattacaaacagtccaagttcatcgcaagcgtccatgaaagccgggtcttgcgggcaatgtgcattacgaattactttcatccctgcatctctcagctttttggcatcgcgccagtgaatgctgtttggcactgcattgcccactatcgcgaagtcctgatggcggttagctcctatcaatggtgtttcataaggccttccgttcagccagaatccggcttctcccttgaattcgatgctgcggatcccgattcggcggcggtatccgtctattacgttgccctgttcgtcacgaacgcggacaatcagattgtatagtgtaggtgtctccgggctccacaacattggattttttaccgtcagcttatcagatgaactggctgccttaccggatttgacacgaatgacggaattcagaaaagctatttgttgtccgtccggttgttgaagctcgtattcgacgactcctttaaaagctttttttccggagttccgaatctgtattttgagcaatacttcggccgagagatccgatacattgtcataagcgacgaataatcctccgcctgcttcttcgttttcataattcggatcggtaatgaatatctgattatgtgccaccagccagcagtcccggtatattcctccgaaataagtgaagtccagcacttcctgttgttttccggggggataattagggtcattgctattgtcggcccatacggcaatcagattgtctttgccaaattccagggcatctgtcacatcgacaactgcaggtagataacctccaaagtgttcggatagtagtttaccgtttacatatattttacttttacccataatggcttcaaagtgcagaaataatttcttgcctttcaaggttgcatccggtgtaaaatgtttgcgataccatacttcaccttggtaattaacacagccgctggcttcagtaggcaagtattcgatgccatggggcaaggaaactacctcccatgatcgatcgttgaagttaacagcttcggcgccaacgcaatttcctttataaaagcgccatgcaggattcatggaatagatctcccgaccggaatcggccaatcggaaaaatccggcggtggagaattctggctgatgcgctttaatgcatagcggggataaaagtagactgataaatagcagaataatgcttttcttcattgtggtaggttttgataatcagttattggtgttttcttttttttgattttaaatcttaataggttggtttcgtaatccttgcggagtacggcgtgaagttattaaaaaagtctaatactcgcaagaggcttgcaaactctttatataaatcatcttttaagctgtataattaccgttcgttattttcatatattcagatgggagagttgctacttgcttaaatagcaattatcttttccgaaactataagataaagattctttagataaagaaggctgtattgtactattttgcttataaccagtgatatggcggtgcttgttttaagcttggaaaagacttggtttaacattgtgttaaaccaagtcttttgtgggtaaatatcaagtctttttaatgcaaaaggtttgatgtttgtgaatggaaagcaaatgatacaaaagaggaattaacaatgttaatttgtacgctccgtcagagaagttgtttggagcgtatgttttatctttgaagcttctttttagcactgtctgtgtcatataaaaaattggaggtatagctgaatagtttttttgatatgaaaggttttttagggttttgccggtttctactaaaagaagttataattagctatttaaaaactttttaaagagataaagtttttacttttgtgtctctatttacctggggattttacgccttgtcggaaacaaggttttaattgcgtaataaaatggaacataaatacttatttattgctgttgatgcagccctgaaagcaggagaggagatattgtctatttataccgatccggcttcggacttcgaaatagagcggaaagctgacaattctcctttgaccattgctgaccggaaagcacatataataatttccactattttgaatgaaactccttttcctgttctgagcgaagaagggagacatttggattatgatacccgtcgtaagtgggaaatgttgtggattgtcgatcctttggatggtacgaaagaatttatcaagcgaaacggtgaatttacagtgaacatagctttggtgaaagcgggggttcctattatcggagttatttatctgccggtgaaaaaagaactctattttgccggtgaagagatcggtgcttataaattgtcggatattacagctttagaggataatgccacacttgataaattgattgccgcttccgtacggctaccgcagggcggtcggcaaaatcaatttgtggttgttgcttcccgttcacatctgactccggagacagagacatacattgaggcattgaagcagaaacacggcgatgtggagttgatatccagtggcagttctattaaaatatgtttggttgctgaaggtaaagcggatgtttatcctcgttttgctcctactatggagtgggatactgctgccggacatgctatagcacgtgctgcgggaatggaggtttatcaggcggataaaaaagatgttcccttgcagtataataaagaaaatttgctgaatccttggtttattgttgagaagagaagataaaccactaattgtttgcgtttatgacatttgaaattgcgtttgtgttattatccttattggggatggttattgctttgattctggacaagatgcgtcccggcatgatacttttttcagtagtggtgttgtttctctgtgcaggtattttgactccgaaggagatgctcgagggattcagtaataaagggatgataaccgtagccctgctttttttggtaagcgagggtatccgccagtcgggagcgttggggcaggtcattaaaaagttgcttcctcagaagcgaacgacggtattcagggcacaattgcgtttattaccttccgttgcctttatttcggcttttttgaataatactccggttgttgttatttttgctccaatcattaaacgatgggcgcgtaccgtccacttacctgctaccaaattcttaattcctctttcgtatgtgactatattgggaggtatttgtactttgatcggtacgtctaccaacttggttgtgcacggaatgatactggaatccggacatgaaggatttacgatgtttgaattgggtaaagtggggatctttattgcaattgccggcatcatttatctgtttgctttttctaaaaagttgctccctgatgcacgtcccgatacggccgtacctgatgaggagatagaagaaggagataaactccaccgggtggaagctgtgcttggtgcccgttttccgggtattaataaaacgttgggtgagtttaatttcaagcgtcattatggtgctgaggtcaaagaaatcaagaaacgcaacggacagcggttcgtcaataacctggaagaggttgttttgcgtgaaggtgatacattggtagtgatggcagatgatacatttattcctacttggggagaatcttctgtgtttgtgttgttggccaacggcaatgataacgaacctgtaccgggaaaagggaaacgctggtttgcattgattctgttgattctgatgatagcaggtgctactatcggagaacttccaatagtgaaggaaatgtttccggacatgaaactggatatgtttttctttgtttccgttactactattatcatggcctggactaaaatcttcccggcacgcaagtacactaaatatatttcgtgggatattttgataacgatcgcttgtgcttttgccatcagtaaggcaatggtgaactcgggagtggccgataaggtggcagagttcataatcggcatgagcgatgattacggtccccatgtattgctggcggttctatttattattaccaatctgtttacggaactgattacaaacaatgcggccgctgcgttggcttttccgttggctttgtcgctttcaacccagttgggagtcgatccgatgccgttctttgtggtcatttgtatggctgcatcggccagtttctctacaccgattggttatcagactaacctgatcgtacaaggtatcggtaactataagtttatggattttgtccgtatcggattacctttaaatcttataacattcctgatttctattttcctgattcctttaatctggccgttttaatgactgaaacaacatctaacatattataatggaagaaaataataacatatatccaatattcgaccggatgctgacccggcaggataaagaaggactcctgaggcagcatggcgtgatgatttggtttaccggtctgagcggatcgggcaaaagtacgattgcaattgctttggaacgcgaattgcataaacgtggattgttgtgccgtatcttggacggagataacatccgtacggggataaacaataatttaggcttttctgaagccgacagggtggaaaatattcgtcgtatagctgaggtttccaaactttttattgataccggtattattacgattgctgcttttatcagtcctaataatgatatccgcgagatggcagcccgcattatcgggcaagatgattttttagaagtatttgtcagcactccgcttgccgaatgtgagaaacgcgatgtgaaggggttgtatgccaaggcccgcaggggagaaataaaaaactttaccgggatatccgctccatttgaggctccggagcatccggccttgtcacttgatacttcaacactttcacttgaagagtcagtcaagcgtctgttggacattgtattgccccgtgtgagcaggcatgaatagaatatagatgaagaaataatcataacaatgaaagaggaatataaattaagccacttaaaggaactcgaagccgagtccattcacattatccgcgaagtggcggcggagtttgagaatccggttatgctgtatagcatcggaaaggattcttcggtcatggtacgcctcgccgagaaagctttctatccgggcaaggtgccgtttcctttaatgcacatcgattctaaatggaaatttaaggaaatgattcagttccgtgatgaatatgctaaaaagtatggttggaatctgattgtggaaagcaatatggaagcttttcatgcgggagtaggaccgtttacacatggaagtaaggtacataccgacctgatgaaaacacaagctttgctgcgtgcactcgataaatataaatttgatgccgcatttggcggtgcccgccgtgatgaagaaaaatcacgtgccaaagagcgcatattctcttttcgtgataagtttcatcaatgggatcctaaaaaccagcgtccggaactgtgggatatttacaatgcccgcgtacataaaggtgaaagcatacgtgtgtttccgttgagcaactggaccgagctggatatctggcaatacattcgcttggagaatattccgattgtaccattgtattatgccaaggagcgtcctgtggtgcagatggacggaaatctgattatggctgatgatgagcgtctgccggagaaatatcgtgatcagattgagatgaaaatggtacgtttccgtacgttggggtgctggccgttgacaggtgctgtcgagagcgaagccgacaccattgagaagattgtggaagagatgatgactactaccaagagcgaacgtacaacccgcgttattgatttcgaccaggaaggtagcatggaacagaagaaacgcgaaggatatttttaaatattacaactatggcagataaattagatataaaagcatttctggataaagacgaacagaaagatttactgcgtctgttgacggcaggttcggtagacgatggaaagtctacattgatcgggcgtctgctgttcgatagcaagaaattgtatgaagaccagctcgatgcgctggaacgcgatagtaaacggttgggtaatgcaggagaacacattgattatgctctgttgctggatgggctgaaggccgaacgcgaacagggcattacgattgatgtggcctatcgttacttctctaccaataaccgcaaatttatcattgctgacactccggggcacgaacagtatacccgtaatatgataaccggtggttctacggccaatctggctattattctggtagatgcccgcatgggagtgatcactcagacaagacgtcataccttcctggtttctttgttgggaatcaagcatgtggtgttggcagtcaataagatggacttggtcgatttttcggaagagcgtttcaacgaaatagtaacagagtataaaaagtttgtagctcctctggggattcctgacgtaacctgcattcctctttcggcactcgatggagacaatgtggtggataggtcggaaagaactccgtggtacgaaggactctccttactcgattttctggaaacggtgcatatcgacagtgataataattttgatgatttccgctttcccgtacaatatgtacttcgtccgaatcttgacttccgcggattttgcggtaaggtggcatccggtgttatacgtaaaggggataaagtgatggctttgccttccggtaaggtatctcatgttaagagtattgttacttttgatggtgaacaggagtatgcttttcctccacagtcggttacactgacacttgaagatgaaatagatgtatcgagaggagaaatgttggttcatccggacaacctgcctattgtagaccgtaattttgaagcgatgttggtgtggatggatgaagaaccgatggatgtcaacaaatcgttctttatcaaacagacaacgaacgttagccgtacccgtattgatagcattaagtataaagtggatgtcaatacgatggaacattcatctgtccctttcctttctttgaacgaaatagcacgtgtggtgtttactacagccaaagagttgttctttgatccgtatcagaagaataaatcgtgtggctcgttcattctgattgatccgattaccaataataccagtgctgtggggatgattatcgatcgggttgaaaggaaagacatgaatgcttctgatgatcttccggttctgaacctgccaaaactgggcataacgactgagcattatgaagcgattgaaaaggctgtgaaatcgttgagtgaacaaggtttcgaagtcagaatagaaaagtaaataatgattcgatgtgccgacgggctggttacggcctgttgacacattaacaactaacacattattatgggattacttgaatttaataaacttcctataaatactctggtgggtgcagactggcaaacatttaaagctattacgggaggaagggaggtcgatgcgccctataaaggtaaatatcgtctgacaaaggctgtttgccgtttactgtctactttggctcctcttcaggataagcgttatgagaagatactggcagataaaccattagagcatgatccggtttttattcttggtcactggcgtagtggaactacttttgtgcacaatgttttttcatgcgatacacatttcggctataacacgacttatcaaaccgtatttccacatttaatgatgtggggccagccgttcttcaagaaaaatatgagttggcttatgccagataagcgtccgacggataatatggaactggccgtcgatttaccgcaggaagaagagttcgcacttgccaatatgatgccttatacctactataatttctggttcctacccaaataccagcaagaatatgctgataaatatttgctttttgatgatatcagcgaagctgaattgaaggtttttgaggagacatttaccaagttgatcaagatttctttatggaatacgcaaggtacccagtttctcagtaagaatccccctcatacaggacgggtgaaggagctggtaaaaatgttccccaatgcgaagtttgtttatctgatgcgcaatccgtatacagtatttgaatctacacggagtttctttaccaatacgattcagccattgaaattacaggatattactcccgccgagttggaggacaatattctttccatttatgctaaattgtaccataaatatgaagctgataagcagttcattcccaagggaaacttgatggaagtgaaatttgaggattttgaggcagacgctatgggaatgactgagaatatttaccatgctttggatattcccggattctccgaagcacgtggtgcaatagaaaagtatgtgggaggtaaaaaaggatataagaaaaacaaatataagtatgatgaccgtactgttcagctggtgcaggatcattgggattttgcactgaagcaatgggattatagtttataaaagaaaggaggaaagatgattcagaagacatatcgcttatgggtggcaggtctggtaactttgtgttctgctcctgctgtggcgcagcagaaggtggagatgttctcttttgggaatatggatcagtgggtgacacgtgagataaaagaatcgggtattattggtggaaataccaaaaaagtatatgccattggacctacggaaaccattgtaggtgcgaaaccttatacgaataaaggagggtctccatgggctacttctaacgttatggcacgcgtgtcagggattacgaagaccaatacttcggtgtttcctgaagcaagaggagatggcttttgtgcacgtctggatacccgtatggagagtgtgaaagtgctcggaattgtagatatcacagttctggcggcaggatctatgtttctggggacagtacatgaaccgattaaaagcactaagaatcctaataaaatgttacagatgggagtgccgtttaccgaacgtccgtcagctatccagtttgactataaagtgaaaatgtccgatcgtgaaaaccgcatacgggcaacgggattcagtaagataacagacgtgccgggcaaggatttccctgctgttattttgttgttgcagaaacgttgggaagatgccaaagggaatgtatatgccaaacgtatcgggacaatggtgaactattattatcattcgactgattggaaaaatggtgccacttacaatattatgtatggcgatataactaatgatccggcatataaggctcatatgatgcgtcttcaggcttctgagtattttacggtgaacagtaagggggagagtgtcccaatccatgaagtagcatggggagaagctgacgatgtaccgacacatatggtactccagtttacgtccagtcatggtggtgcatatatcggatcgcctggaaactcgctctatattgacaatgtgaagttagtatattaggactctgtcagacgaaaaggataagcgaagatgtgttcatgaataatggacacatctttttttgttagtttacattggaagaaaatattccggagaggggcatgacttgacaaggcaagaaaaaaggtacgtctcagcgacgtaccttttcaaagtatagagcaatttgtttcccgctctattaggaaatcgaaaccctattattctaaaattacaacacggttcaggaagttcttgccaaacatgttggcagttccaccgaaaccgatgagttccagttgatctttgcttacgccttctttgataagagcgtcatatacagcttgggcacgtgcttcagatagtttctggttccactttgcactaccggtagcttcatctgcatagcctgccactttgtatttcttatccggattagccttcaggatcttagctgccaaccggatgttaaccatgccgtagtcatcgattttagatttgccaatctggaagaaaacagcacgaggaccggctacttcaacttccttcacaacttcttttgttacaggtttcacgttagccagtgcgttcttagcatcagccaagtcagactgagcttttgacaattcacttctgtaacgattcaactcttcgttaatagcactttggtctacctgggcaccacaagatacgaatctcttacctccgaatgtgtaagtaacacctgctgtcagagaaacagcgccatccgtatgagctgagctatagcgtccgaatacggaaggggaaacttctcctcttgcctctacattaatgtccaggtatttgttgatgttaaattgtcccatcagaccaacagaaccattaatcagtgcatccagtttatcctggttgccataagccttggcaaacgtaagtcccggaccggcaaacactgatacggtgaacaaacggtcggggttgtagcctccgatggcatttgacaaattgaacaatccgtcggcacgcaaagtgaagtactttttattcttcattttgttatattctccttccggcataccgtattcggagtataatgtgctccagcatccggctacctgaccgcggataccccagatagggttgaacagtttaccgactgatgcatggatcagcggagttatggcatgtccgaagccataatcaaagttgtcagggtttacacatccctgtgctcccacacccacactgataaagatattatctttagctttctcgctataataatgctctttggtctgggctgaggcggagatggctgcgcctgtcaacagtaaagacaatattgctattctacttttcatgttatttcattttttattttaactctttgtttcgtttttgcttttttattccatttttccctgacaagcggaactggagtgtcaatcctcccgtaacgtacttcatcttttgtaattccacttgtgcgtgtagatggttgaaaagcaaataggtggcacctaacgcaaaatctttcgaatcatattcggcaatcaatctcaattgcggatggaaagacggattgtagctgatacctgccgcgatcccattcagtttgtattctatccgtttgttataaaggtaggagaggtgtactcctattgtctctgatcccaatcggatatgtttggtggctgcgacatagaaacggctgaaatatccgttaccttcggtcggggcgacaactccgtcaccggacgaggtaaaaggatcggaggttcctattaccacagcgggcatgtatttccagaactgtccctctttcaatgctcgtaatctgagagaaaaataccggtcctgattggtgaaccctgagtaaccataaggctttaatccaagagcttctgccttgaacaaagtacaagtatatgccacttccatccaaggtagaatggttacattcaggtagtaattgtacgtatgataataccacgtcggaggagttatctccttattcataaagttagcacccagcatcactgttttatccttttgcatctctgccgaaggggcatgcagtaatcccgtagtaccgtaggtcaattgagccgaaagcataaagggtatagctataaatagcgatacgatgaagattcgttttaaatttattgtatacattctctacgctttcggttcaatgatttcaattactacatttattttctcgattattcagagatgatgataccaccaccggcattcagatcatcaccgtgtccgtgaccatgtccgtgaccgattgcttctatagtttccactactactgaagaaaccttgctgattgtaactgtagctgttttcttttcaatagctttggtcgctttgttgtaaacggcaaacggtaatgtataagtcgttttgataacgtttcttgttaccttgaaaccggtcaactgtgtgtaagcaggcacttccagttcgtatgtgaattttttatctgtaaaggctgctcccggagtaacattagcgttgtcatctttaatagcttcttccaaagcagcagcaaccatcttgatggtggttgaggtcaaagaagaatgagctttcttaacgatttcttctacagaagcaccgttttcgcacttgatgccacccttccagttgatttccatttttactttagctgtttcaccttcagtgtagcatgccttatcaaaattcatagtgtctaatgcagcttctgcatcagcttggctgtcagcttcttcaaaaccgaatttaaacttagagaagtggtggacattgcctacaaatacaccattctgataagttgcgtagttttcttcagcttcccaagtgctggtcttttcgttgaagtagagagtagccagtgcaacttcaggagtttctccctgagcaacaacaactgcaggtgtgaacttcacttccatcggagtaacgaagatagtaccggtaggagtaccgtcatattcgcggatagaagcaccttccttaccttcgtcggtgcggctgatgttcagagtacttgccacgccgcttgtgaagataaccactgtgttggccggaagaacaatttcgtcagtaactgtttcttctttgtcgttattggtatcgatcactttagattccagtttgaaagtagtttctttttcgatcggaagaactgctactttatcgatttctgtcaaagttccgttagcgatgtatttctccatggtgttaaccacttgctctgcttgtgccggagttatcttgatatccgatcctgcagcttccaataccttgttgattgattcttctactgcagacttgctcggtactttttcaccttctgctttttccggagcagcttctacggcattttctgttggaagttcgatatctacgttaccgccgataaatacattatcgtcatcagcaggtttttctgtgtcaggtttcagaatcagtgtaacgttgactacggtgttagatacctgaccattaccttccggtgctataaatgcggtatatacataaattttatagctattgtggcggattgttacagttgctttagtcagcccctttatcttgtcggctagaatttcgaacttataaaaaccgttggaagcagttgcgacagtttcatatcctgaaaggtttagtgtaacttcagccttggttaccataccaccatcttgattatagatgtttcctgacagataatatttaggagcaatctctacttcgtttttctgcatagaaacggttaccggagtttttgcaatgaaaatgccttcgccttccggacctgttacttcactgatggcaacattggcagtagtcggtttgtatccgtcagcagtaatatagattgtatgctgacccagacttacgttagacattgtgaatttgttaccattctggatagttgctgtcagtactcccggaatggttgcagctttaatagttacggcttcaccgctttctgcatcaaatacggaaccttcaatctgatattctacatccattgtcggttttgtttctttgcctttttccattctggcatcaatcgtataggcaacgatagaaccattttcctgtttggtaacaaatacagagcttgtcactgttttgtagccgctcttagcaaaagtcactacgttggtttctcctactttggcttccaaagcgtacttaccgtctgcggcggtggtcattgactttgagtttgtaacattggttaccgttacaccatccatcacagcattgctttcagcatctgcaacaatacctgcaactcgatatgttgttgctgtaggctcggtcactttaggtacatcaatctcatctttttcgtagcaacttgcgaacataccgcacattgctaacagggttaacgctaatttagcgctactaccgaaaaatttacttttcattttcatctcaataaaattaaaaatttaataactcagattttacaaaatatggattaaaactattattcttcattatgttgtcatcgggtgccggccgataagttttatagtaatattgttcatttcctgcattataggacattcccatattgttggagggtgtgatccgggggatatatcctttacgtttatatcggtaaggaggtaaggctatctggaaacggaaacctccattggcttttacattcttggctttcatggcataaaagccgatagaggcatagcgaaaatgccggattgcttctactctgaccgccttttcttgcagtagatattgttccactcttgcatttagttctacattatagcggggccaatagaaacttcctcccaatgaccatgttgtacgcatctttgtgccgtagtgcatagtaaaaccttcccaatatccggttccggtatatcctatacgtccttctacgctgaaacgttcatcgttgaaatgatgaatcagattgaaatcaatgccatatcggctattattaaaattacctacagacagtgttgcccataagttataaggtaaacgaaccgtttgtgatagttcaaggaaacccggatgcactttatcgtatctgctggcatatccgtcattgtataccggaatcaccatttgagcggtgaatttcatccctctccataaagagacttctatggcgggtgataaattgaaaagtacttgatagatttgcgttattaccagattttttagtgataattccggatatattgtgatatctactttatacaaagagctattcttttttttattcctttttactttgttccagctatttccaagattatagctgacttcccagtcttgtttgctaatatctatggtactgtcttttttagatggctgataataaagagaaatctgaggaacgttgttattcaaaacgataattcgacatggctttctttcgggaaatcgatatatggttttgcataatatggttttgcttgttgtttgattttagattgttaatatatagtgttttatgcaaatgttgcttttgcctggtttattatgattttgattgatctttactttcatgaagtatgtatgttaccgagctgctactttaattaagactcataaagaatctttgtgaaattgataagtagctaaaaaacagatgtttatttgaattctgcaggcggatatcgtctaatcatttttctttagaaatcttttttctgagacttttgttacctgtttgttacttataacggaataatgtctatatttataactaataacatgcaaacaaataatatgaaaaaagaagtaaggattaaagaaccggttagaattagaaccaagtgtctgtcgaatggttgtgagtctatatatttagatatatatatagatggaaagagacaatatgagtttttaaagttatatataatacctgagcatacgcgggaagacaaagatttaaatcagagtactatgaagcttgctaatgcggtgaaagctcaaagaattgtagaattgcagaatggaatatatggctttaaccatcaaaaagagaaaaaggatataacactgatagactatataaagtatttggcagacagggatatagaaaaaacttcaagaaaagtgtctatgtatactttgatatatcatctccagcgttatgataaattaggtattaagcttaggcagatagataaaaagtatatactcggctttattgagtacttgaaaactgcaactcagaagcattgcaaaagtataaagcatataaatgccaatactcaggtatattattataaagtttttcattattgccttaatagtgccataattgatgaaattataatctcaaacccgatggataagataaaaaaagaggaaaaacctaaacgtaaaagaaccgaaagggcctttttaactattgatgaagttaaaacattatcgcaaacggattttcataataagactttgaagagggcttttctatttagttgtttttgtgggttgagacatagtgatatagtggcacttacatggggaaatctgaaaaaaaataagatagggaaaatagaactgcatatgacacagcagaaaactcaggaaatcctttcgcttcctttgagtaatgaagctttaaaacaactcccggtccgtgggaaggctcaggatacagagaaagtattcaaaggactgatcagtttaggaaggaccaatgagatattgccaagatgggctgctaaagccggtattcaaaaacatatcacatttcattcggcacgccatactcatgctacgatgatgattactcttggggctgatctttataccgtgtccaaactcctgggacacactaacattcaaacaactcagatatatgccaagatagtagatgaaagtaaagagaaagctattgatctgattccggatataacttgagagggtgataaatggttcgggtatgtagttgcgaaaatgtgaacctcaatcttatgcctgaatgttgtggagtaacgataaaaagctaataagacataagatattgacaaacagtgacattaaatactaatatcttgggtttacgaagttaactttaacactgtgttaaagttaacttcgtaaacccaagatattaacttcgtaaatacataaggttaacttcgtaaatctaagaatataattggctgcttttgtagttaacattgttaattcaactgctttatatagtaggtttatattaatatatgaatacattattatatatatactggtctttccgatgcatttctgttttagttggtaataattgtgcatttggttagattagctactacttgattttacccggatttagtaaatttgtaatatagcggtattttattggaaatttagtattaatatatatttctattttattttatcacttctttatctatataacttgctctattagtgattctaaaatatataatggatattatttaagattataaatggtttttctggtctatttttaagtaagcaggagttcgaatgaaaaaaactgatacaaatctgcgaaaaaacatgtaaaactctttggtattattaaaattgtgtctatttttgcaccatattttgtatctataatttttagggtacataagttttaaagcaaacaaatgaatcacaaaagcccttacatgaggaaaaacataacaattgacgctactttgctcagaattttactcatatcattctgtttactccctttaaaaggtgtatgtcaaacaggagaggctactgttgacgcactggtgaaaatgggatttgagaatgtagggtggacagaagataatgaggaacgggtttttgtgatacagaattcagcctatcgtcttgaaggagtcggaataggtaaagctgttgatttgattcaaaagatgggtttacccgaaaataagccatgtaggttaatagttttggacaataatatacctcagatatctctctattatcagccgatgaaaggaggcagtattgctgaagcaaatcgggctgactggaatgtaagttatgatttgggagaaggatggaagcaggcaagacgtattaagaagcaaaacagttctttgtttaaggtagatatagtggtatatccggaattattattcagaaactatattttgtctaaggtctatgaaattgtggttaatgtctctcctgctatagaagtttctttgtggaagggaatgaaactgaccggacaagtgattttccctatctataatgattatggtcaaaggtataagcagatccgtcccggatttgtgactttgtcacagactgtgcgtttgcctcaacgcacatttctgacagcctcagtcggattttttaataagtttcgctggggaggtgatttaaaagcaaaacacttctttaaagatgagcgcttttcagtagatgcgcgcatcgggtataccggaagagggtattttgaagagtgggccttttatcatggtaccaaatggactctgaccggttctatcggagctaatttctattggccgaaatacaatacacagtttagtttaaaaggagagcgatatttggaggaagaatatggagtccgttttgatatggttcgccattttcgctatgcctctattggcttttatggaatgaaagtgcaacatgcaggtaataaaggactgaatggaggtttcttgtttcagatagctttgcctccatacaaatataagagaaaggggtatatcccaagagtaatgcctaataatttcggattccaatataatgcgggtaatgaacgtatatatggtaaagggtataactctcaggcaagtgataatgtaatgaatgataatagttttaatccatattttgtaaaatcagaattattaaatttttaattttattgagatgaaaatgaaaagtaaatttttcggtaatggcgctaagttagcgttagccgttttggcagtttgcggtacactgtttacaagctgctacgagaaagcagaagttgatgaagcaacaaaaccagcccctgcaaagtattatattgccggtactattactgacgcaactacaggtcaggttttgactactgctaaagttacattgggtggcgaatcagttggagctacattcaacaaagaagttacttataaagcagaaggatatagcttggaagtttctgcaaccggttattattctgtaacaagacaagtatacctgaaccaggttagtgacggtcagacaagtgttgctactgtagacgttgctttggtttctgttgaagcagcaactattcctccggtagtttctccgactgatcctaagactgatgttactgaatctgaagccggagcattggtaactaaagcagctgaagaagctaaaccttctgctgaaacagttaagaatatgtgggatggtgcaacagctacagctgaggaaaaggctggtctggaaactacaaaagagttgaccggtgacgttactactggagctactactgctgaagctcaggctgatggatcgatcttggttactactccgtttgaatttgcaaactctgttaaagatgccgctatcttggttccttacttctacaatgaaggttgtgaacttacaggtgatgtaaaagaagtggctgctcctgcaacaagagcagaaggcgctgtttctactgatattcaggctgctttccttgcaaatgctgctaaagctttgaataagaatgccggtttcgtacagaaggttggttatgctaagatcagcgtattgagcggttatggtattattggctatagagttaaaggacaattggtttctaagaaactgacattcttgatctctggcaaatattatgaaggtatcgtttcttaccagaacagcgtaatgatctatcctaactattacagccacgattctcacgattctcatgactctcacggcttcaacccgaacgccggtggtggatctaacgactaatcagaggtaaaagtaattgttgagaattaaaaagtacgagttgaaccgaaagtatagaaattgcaggtaatgatgaaaaagatacttcttatgggcttgttcctttgctgtcatttggcactttcggctcagttgacgtacggaactaccggtttgctccatgctccgtcagcagaaatgcaacgggataagacagtgatgatcggtggaaattttctaaataaggagataactcctcctacatgggactaccatacgtataattactttttgaacgtgactatctttccctggctcgaaatagcctatacatgtacgctgtttcagtcgcagactatagggattgactggaaagttggaaagaagaagtttacgaatcaggacagatacttttctgcccgtttgcgagttttgaaagaaggacaattgtggaagcacatgccggctgttgtagtgggaacttctgatccttatactgagtcaggcgatgggcaagtaggttctgccgatggtaatggctatttttgccgtttttatgtcgcagccaccaagcatatcccggttggaaaggagaagataggtgtgcatctgtcatatctgtacaaccgaagagtggattaccacttgaatggattagccggagggctcacttatgctccatcttttgctcctgatctgacagtgatcgcagaatatgatgcaaaggacttcgcgtttggtgctacctatttgcttttcaaccatttgcatgcgcaggtagaattgcaaagaatgaaatattttaccggcgggcttacatataagatttatttgaagtaagcagaatggtcggagcaaataagaaactaaaagagttgaaatatttaaaaacaaaaaacaatgaaaagtaaattagtaatattatctttattgttggccggtgctactgcagctactgctcagactaaagagacgttctatagcgaaagctttaaggacaatatctttgtgagtgtaggtgttggcgctcagggttgtgtaaacccggacaactttgattatggctttggtaaagccataactccgctgatcaatgtgtcagttggtaaactgttcaatccggtttggggtatccgtggtcaggtggctggcgcatggactaccttgtattctaactacggacaacctgccgatacttatattaagagcaagaataaacattacttcactctgcgtgcggacggtatgtttaacttgtcgaatgctattggcggttacaatccggaccgtttgttcacagtttctgtttttgcaggtcccggtttgacatttgccaaagcttatggcgatcaggataaagtaaatgcactgatcaacggttctgttggtttagccggacagttcaatatcaataagtatttagatatcaacattgaagcaagaggcgaggtttctccttctccgttcggtaatattagctctgcccataccgacggcgctgtttctctgactgcaggtgtaacttatacatttggtggcaagagattcgtatcttgtggttctcaggtagaccagaatgctatcaatgaagaactgaatcgttacagaagcgaactggctaaggctcagtctgacttggctgatgccaagaacgcgctggctaacgtgaaacctgtaacaaaagaagttgtgaaggaagttgaagtagccggacctcgcgctatcttcttccagattggcaaatctaagattgacgactatggtatggttaatattcagttggctgctaagatcctgaaggctaatccggataagaaatataaggtggcaggttatgcagataaagctaccggtagcgccaagtggaaccagaagttgtctgaagctcgtgcacaggctgtttacgatgcacttattaaagaaggtgtaagcaaggatcagcttgaactggtaggcttcggtggaactgccaacatgtttggcaagaacttcttgaaccgcgttgtgattctggaataatacaactttattgaggcaatagcccgataaataatggaaggggtatccgcacaacggataccctttttgtttgttaaataggggataatccaaattttaatcgtatttttgcactccaaatatgagtagaataatagcaatagattacggacgaaaacgtacaggaatagctgtgagtgatgcgatgcagattatcgctaacgggctgacaactgtaccaagtcatgaacttctggatttcataaccaattatgtaaaacaggaaccggtggaacgcattattataggtttgccgaagcagatgaataatgaggtttctgaaaatatgaaaaatatagagccttttgtacgttcgttaagaaaacgtttgcctgatattcccgttgaatatgtagatgaacgttttacttctgtgcttgcacaccgtacgatgattgaagccgggcttaagaaaaaagacagacagaacaaggcattggtcgatgaaattagcgcaactattattttgcagtcttatctggaaagtaaacgtttgtaagaagaaacaatatttaaaaagaataattataagatatgattttacctatttatgtatatggtcagccagttctcaggcaggtggcggaggatatcacgccggattatccgaacctgaaagagctgattgaaaatatgtttgaaacgatggatcatgccgatggggtagggcttgccgctcctcagattggcttacctgtccgcgtagttgttattaacctggatgtgctttcagaagattatcctgaatacaaggattttcgtaaggcttatataaacgcacatattgatgttgtggagggtgacgaagtatccatggaagaaggatgtcttagtctgcccggcatacacgagtctgtaaagagaggtagtaagattcacgtacgatatatggatgaaaattttgtagagcataacgaagtggtagaagggtttctggcacgggttatgcagcatgaatttgaccatttggacgggaaaatgttcatagatcacatttctcctttgcgtaaacaaatgataaaaggaaaactgaatacgatgttgaaaggaaaggctcgtagctcctataagatgaagcaggtgaaatgatatacctgagattttcgaataaaaagcaatgggtaaagttgatcatataaatcaattttacccattactttttcaggactgcatctcaaatatcctgcaacggctatttgatgtttttcttaaaagagtccggttatggttgctttaaatataccagcatcattaccggattatcttcttcctttaagcctttcaactgttcgatttgaagtatggaaggcgtttcttccgctttttctaaaagttcaggagcttcccatacatataacagtgtatggctgtcaagtgccgttatcgggcgtaatggtaaaccaggagtcaagtcattttttatatggcctgtggctactttgaaacagtttttggcttttttgtcgtaaatagccatttgtctttctcgcgctttctctcctgcccaattagaataaggcatgaatatgtaggagtcagtctctatggcactgtactgtatgtaaggagcggccatttcctgaaaacgctttccgtttccatccagatattcaaacctgcattccatcggtaatgagtatttgcccatctggaatatatatcggggttctaaagcttctggagtgacggtgaatagggtgtcgttataatattctttataacaggtatggttttcgtaatggaacatataacgatctatatcactactgatcatccagcgatattggctgtttagctcaaataggtcccaacgattaaagatttgcaacgtatcacctttcaggttggaaaggtaaatgcgttcttttcgtcttccgttattattgcgcatgaatgttgcggcaattgtatcctgaacacgtaacatcgcaaactcactaacttctatattagggactttcattgcacggatgaatttacctgtttccatagagtagatattgatttttcctgtagttgttagcatgtagaccaatcctttttcttcatccacgtcaatctgcatgatccagttaaattcacccggtccaccgcctttgcggcccagtgtccgtatgaatttaccatcttttgtgtactgaaataatttatcgagccatggtaggaagaaatactcctttgtctggatgatattggttccctttaaccctcttatcaggcatttattgtttgtctccaacgggatataccgtattgaatcggctatttcactcagtagtatttcccgttctgtttcgatacctgtttcgaaaggtacgatttgagggaattctggttctgtaatttggaccgttgcttcggacggctggtcactgttcttctttccgctgcaagaaagcagcaggaaaggtagtagtaaaagaagtgatttttgtttcatgttgatactattttctgtataaaagagttcctgtttgcaatattgtacaggtgtctttctttctgtatttttaattttcggataacccgtttcatatattgatttatggacatattacaaatctacgaaataatcgtaaattaataatgaatgtgaagttaataggtgttaagaaggtgtatagactactgaatatctgcatggaggggtcctataaaataatcaaaaaatataaaaagttgtccgttatccctgtttaatagatgaaaagcattacttttgctctacttaaaaagtattcagaagccgatgattaaaaagatattagcagcattattgttgtttcctacatttatatatgctcagataaacacagacagggtaatgatgattgcccgaaacgcgttatactttgaggactatgtcctttccattcagtattttaatcaagtgatcaatgcaaaaccctacctgtatgaaccctattttttcagagggcttgccaagatcaacctggatgattatcagggagctgaagatgactgtgatgcggccattgacaggaatccttttgtagtgggtgcttatcagattcgtgggcttgcaaggattaaacagaataagtatgatggggctattgaagactataagaaagcacttcattttgaccctgaaaatattacgctttggcataatctgactttatgccatatacagaaagaagactataaagctgctgaagatgatttgggtaaattgctggcagttgctcccaaatatacaagagcctatctgatgagaggagaggtggctttgaagcaacaggatacattgcgggctttgaatgacttcaatacagctattgagatggataagtatgatcctgatgcctgggcatcccgggccatcgtcaggttacaacagggaaaatatgcagaggcagaatcggatttgaatcatgcaacgcatttgaatgccagaaacgccgggaattatattaatcgtgctttagcccgtttccatcagaataatctgcggggagccatgagtgattatgatctggctcttgatattgatccgaataattttatcggacattataaccgtggtttgcttcgggcacaagtaggagatgacaatcgagctattgaggattttgattttgtactgcaaatagaaccggataacatgatggctacgtttaaccgaggattacttcgtgcacaaacgggggattaccggggagccattaaagattatacaactgtgattgatatgtatccgaactttttggccggatattatcaacgtgcagaggcaaggagaaagatcggcgaccgtaaaggtgctgaaatggacgagtttaaagtcatgaaagcgcaacttgacaagcaaaatggtgtaagtaatagcgataagaccgtggctgataataaaaaaagtaataagaaagaggagactaaaactcgtaaaaagtccgataaggatatgaataattaccggaaaatcgttatcgcagataattctgaagtggaacagaaatataagagtgatattcggggcagggtacaggatcgtaatgttaatatcaagatggaaccgatgtatgctcttacctattacgagaagatgagcgatgtgaagcggacggtacattattataagtatatagatgatttgaatcgtgccggtgttttaccaaaacgtttgtatatcactaatatggaatcaccgcttaccgaagaacaagtgaagttccactttgcattgattgatacacatacttcggcaattgttgaaaatccgcaggatgcacgtatacgattctcccgtgcacttgatttctatctggtacaagattttgccagttctgttgaagatctgactcaggccattttgttggatgataaattcttccctgcttactttatgcgttccttggtgcgttgcaagcagttggaatatcaaaaggcagaagaagctaatgcagcctcggcagcaccggccacactaccgggtatatccgctccaccgaagtcggaaatcagtgccttggactatgatatagtgaaaagtgacttggatcatgtgatctctttagcccccgattttgtttatgcgtattataaccgtgccaatgtattggccatgttgaaagattatcgtgcggcaattgcggactatgataaagctatcgaattgaataaagagtttgcggaggcttattttaatcgtggattgacacatattttcctgggtaacaataagaatggaatagctgacttaagtaaggcaggcgagttgggcattgtttcggcctataatatcctgaaacgatttacagaagtgccggaataacattttttagataaaaaatagtaaactcaaaaagaaatccttatttttgcgtgcaataatgaaaaatataacataacattatgataaaaataacatttcctgatggctctgttcgtgagtataacgagggagtaaacggactgcaaattgcagaaagtatcagttcgcgtctggcgcaagatgtattggcgtgtggagtgaacggtgagatttatgatttgggacgtcccatcaatgaagatgcttcggtagtgctttataaatgggaagatgaacagggtaagcatgctttttggcacacaagtgctcacttgttggctgaagctttgcaggagctttatccgggtattcagttcggtattggtccggctattgaaaacggtttctactatgacgttgatccgggagaggctgtcatcaaagagtctgatctgcctgcaattgaggcaaaaatggctgaactggttgcaaggaaagaagctgtggttcgccgggatattgcaaaaaacgatgctttaaagatgtttggcgaccgtggggaaacttataaatgtgagctgatttcggagttggaagacggacatattacaacatatacacagggtgactttacggatctttgtcgtggccctcacttgatgacaaccgcacctattaaagctattaagctgacttctgttgccggtgcatactggcgcggacatgaagaccgtaaaatgctgactcgcatttatggtattactttccctaaaaagaaaatgctggatgagtatctggctttaatggaggaagctaaaaaacgtgaccatcgtaagattggtaaagaaatgcaacttttcatgttctccgatacggtgggtaagggattgcctatgtggctgccgaaaggaactgctttgcgtttgcgtttgcaggatttccttcgccgtatccagactcgttacgattatcaggaagtgattactccgcctattggtaacaagttattgtatgtgacttcggggcactatgcaaaatatggtaaagatgcattccaacccattcatacaccggaagagggtgaagaatacttcctgaaaccgatgaactgtcctcatcattgtgaaatttataagaatttccctcgttcgtataaggacttgcctctgcgcattgctgaatttggtactgtgtgtcgttacgagcagagcggtgaacttcatggattaacacgtgtgcgtagctttacacaggatgatgcacatattttctgtcgtccggatcaggtgaagggagagttccttcgcgtgatggatattatttcaatcgtgttccgttctatggatttcactaactttgaagcacaaatttctttgcgcgataaagtgaaccgtgaaaaatacattggcagtgatgagaactgggaaaaagctgaacaagctatcattgaggcctgcgaagaaaaggggctgaaagctaagatcgaatatggtgaagctgcgttctatggtcctaaattggactttatggtgaaagatgctatcggtcgtcgttggcagttaggaactattcaggtggattataatctgccggagcgcttcgaactggaatatatgggatcggataaccagaagcaccgtccggtgatgatccatcgcgctccattcggatctatggaacgttttgttgctgtattgattgaacataccgccggtaaattcccgttatggctgactccggaacaagtcgttattctcccgattagtgagaagttcaatgaatatgcggaaaaagtgaagacttacttgaaaacaaaagaaattcgcgcaattgtggatgatcgcaatgagaagatcggccgtaaaattcgtgataacgagatgaagcgcattccgtatatgctgattgtcggcgagaaagaagctgaaaatggtgaagtttctgtccgcagacagggagaaggagacaaaggaaccatgaaatttgaagattttggtgaaattttgaacgaagaagttcagaatatgataaataaatggtaactttgcgcccaattgtaaaagcacagcattttgataatgttctaaagacagcttttactttaatacataatttaatttggtagacaataaaaaacaaactggaagtaaacgttatttaatgaagaatgacagtatgaaatcgcaatatcggatcaatgaacagatccgtgcgaaagaagtccgcattgtaggtgatgatgtagagcctaaagtatatcccatttttcaggcattaaaattggctgaagaaaaagaaatggatctcgtggagatttctcccaatgcccaaccacctgtttgtcgtattattgactattccaagtttctgtatcagttaaagaagcgtcagaaggaacaaaaggctaaacaggtaaaagtaaacgtaaaagaaatacgttttggtccgcaaacggatgaccatgactataattttaagttgaaacatgctaaaggctttttggaagatggtgacaaggtgaaagcttatgttttcttcaaaggtcgttccatcctttttaaggaacaaggtgaagtgcttctgttgcgttttgctaatgatctggaagactatgcaaaagtcgatcaattgccgattctggaaggtaaacgtatgacgattcagctttctccgaagaagaaagaaggagttgtaaagaagcctgcggctcccaaaccagctgctccggctacagtaaaagcagaaaagcctgctgaaaacaatgaagagtaagaaaaatgcgtaacgcgcaggtatagtgcgttgccatataatttaataatttaaaaacaattaagatgccaaagatgaagactaactccggttctaaaaaaaggtttacccttaccggaacaggtaaaatcaaaagaaagcacgcttttcacagtcacattttgactaagaagtctaagaagagaaaaagaaacctgtgttattcaacaactgttgatacaacaaatgtaagccaggttaaggaactcttagctatgaagtaatcaaaagcgtacaaagtattattaaagttattaaccgaatgctttagcttcaagttcgttacgtgaagtaacggcgctaacattcaaaaaagagaaaactatgccaagatcagtaaatcatgttgcttcaaaagcaagaagaaagaaaattttgaaattgaccagaggttactttggtgcaagaaaaaatgtatggaccgtagctaaaaacacttgggaaaagggtttgacctatgcgttccgtgaccgtagaaacaagaagagaaacttccgtgctctttggatacaacgtatcaatgctgctgcacgtctggagggaatgtcatattctaaactgatgggtggtctgcacaaagccggtatcgaaatcaaccgtaaggttttggctgacttagctgttaaccatccggaagctttcaaagctgtagtcgctaaggctaaagcagcttaagttccgacagttttatgatttacaaaatgctggttacattaactgtaaccggcatttttcatttttaaagctgggtttataatttaaaaaatagtctaagagagaaacaaaatcttctttttccttgtttatctcactaaaagtaactacatttgttgtagtaaaatattagccgcattgattggatcgggaaactcatcaattaaactgaaaaccgagacaagcttcgcttctcaatggcgggccacatccttcgggataactttatagtcggtggattacaaagaggacgggcactcaaatcatgtcattcggagtttcatcacatcatcggtgcggctttttaataaaggaaaagggcggtaatcatttaaagactaccgtcctttttttatgctgttttcttttaaatacacatatagttatgatattctatttttcaggaactggaaattctaaatggattgcggagcagattgcaagggtacaaaacgaaacacttgtttttatgccgaatgccattagggatggaataaaagagtttgtgttggcggataatgaaaaagtaggttttatttttcctgtttattcatggggacctccgttggccgtgttgcagtttctggattgggtcactttggctaattatcactcccaatatgtctatttcgtgtgttcttgcggagatgatacaggattgacggagaaagtgttttgcagggcgttatctcgtaaaggaatagagtgtaatgccggattttcggtgacgatgcctaataattatgtgttgcttcccggatttgacgtggataagaaagaattggagaaagagaaattagaaaaagctgtcggcagggtagaagaagttaactactcgataaatgctcgtgagacgggttttcattgcaatgaggggagttttccatggttgaaaacgaagatactgaatccgctttttaatcgttttatgacttctgcaaaaccgttttatgttactgatgattgtatcggttgcaagcgctgtgaaagaatatgtccggttgggaatgtagttgtgatagggtggagaccggtgtgggggatggactgtacatcttgtttggcttgttaccacgtttgtccgaagcatgcagtgcaatatgggaaaagaaccagaagtaaagggcagtatttaaaccctaatgtgagtatttcacacgaatcagctaagtagaaagtattataaagaaaagcctttgtatagcctgtccgggagaatacaaaggcttttttacagagttaatcttttattgtaatctggcaattggataaatcctcaataatggcaagagactctactcttactcctctttcttcaagtgttttacgtccgttttgaaatgctttctcaatgatgaatcccattcctaccagattggcaccagactgtttgatgaggtcgataacacctaaagcagcgtttccataggccaagaagtcatcgacaaataatatattgtcttttggggtaaggaagtcagagctgatgactacttcataatcacggtctttagtgaatgaatgtactgtagtgctcaaggcattttgtatggttcttggcgactttttcttggcaaaaacgacgggtaagtccattaaatagcccgtcatgatggccggagcaattccgctggcttctatggtcatgatcttattgacgtttgttccggcaaaaaggcgcacaaactctacgccaattgacttcattagtaccgggtccatctggtggttgataaaactatctactttgagaattcccccttcatagcattttccgtcttgcaggattctttttttaagtaattgcatgattataataataagttaatgtgcccaatatgccaatgcgccgatgtattcggatggtacatcggcatattgggttcattggatgattatttattgtttctcaggtccttcactctgacagctttgccttcactttgtggtagagagcctttctttaccaatttgagtttgggcgtgacaagtatttcgtcttttagctggcgggtaatgtccttacgtatcttttcaagttcaatgtaattgtctgtagaaagatcgctcaattctacttctacaatcatttcatcttggttgttaacagtctcaagtgtgataaggtaattgcttcccaattcggggaattgtaccaatatcttttctacttgcatggggaagatgttgactcctttgatgataaacatatcgtcactacggcctttgatgcggtcaattcggatatgggtacgtccacagggacattctcccggtaaaatacgagtgaggtcacgtgtacgataacgtatgagcggcatcatttcccgatcaagggtagtgagtacgagttctccgatttctccttctgggacaggttctccggtttcgggattaatgatttctacataatagcaatcttcccaaaagtgcatgccattctgctctgtacactcaaacgcgacaccggggccgttcatttcggtcattccaaaactattgtatgctttaacacctaacatgcgttctattttttttcgctgttcgtctgtgtgtggttctgcaccgattacgagagttttgagagtggtactgcatggatcgatcccttcttcctgaaagacctcagctaagcggatggcataactggggatggcgtggagggcagttgttttaaagtcggtaataaacttgatctggcgtttactgttaccggcagcggcaggtacagttaaagctcccagccgttcagctccatattggaatccgagtcctcctgtgaacataccgtaaccggaactgttttgaaaaacatctgtattacgtatgcctacacaatataagcatcgtgcaaccagattggcccatgaatctaagtcatgctgtgaatggacaataaccgttggtgttcctgttgttccgcttgaagagtgaatacgtactccgtcttctttcatatttccggcgacaagtccgaaagggtaattggctcgcatatctgcttttgtggtaaagggcagtttacggatgtcgttcagtgattggatactttccgaagtgatgccatgctctcgaaatactttcttgtaataaggggcattggctgctatattaattgttttcttgagtcgctcgagttgtagttcctgcagttttttacgactcatggtctctatctcttcttcccaatattttgtattcatggcttataaattatttaagtagggggggataatgtatcaaggtgataatgcaacggttgtcccgatcacattatcaccttttctatattcaattgttcctggtcatttcatcgttttttctgcgatctcttttccggcagccaaggcttttaaattgagttcgactattgtatcaccttttttctggaatatttcacgaatactatcctgtatcttttcataatcgatgcctaagaatgggatagtggcacctaataaaacaatattggcaactcgtgtagagcctatttctttggctactttatctacattcagaacaaccttatgcggcagtttattgatttctgccataacatctgcctcagcgggataattggggatattaacaaatggagtttcatttgttaccaaccaaccttcatggctgaggtaggggaggtatctaagcccttccatgggttcaagggagatgatcaaatcacatttacctgagggaatcagatctgatgcaatgggctggtcactgattcggagattcgactgtacatctccgccacgctggctcatgccgtgcacttctgcctgtttcatgtacagaccgtctttgagggcggcctttccgattactgtagcgatggacaggataccttgtccacctacacctgataatatgatatcttttttcatggcttacttacttctttttttacgtgctaatgtttgtatacactctctgcgtgggatgataacggatactcctctataatctatttcctcacggatgatctgtttcatctcttcatagtttttctttaaaggaacaactatacggatgtgagccggaactacgcctaatccggcgcaaatagcttcaagtcggcctgtgccggcagaatcttgtccaccggtcattgctgttgtttcattatcggatatgacaatggtaacattggcattctcgttgacacagtccaaaagtccggtcattccggagtgagtaaaagtagagtctccgattacagcgacagccggatggagtccgccatcggatgcacctttagccatagtgatagatgctcccatgtctacacaagaattgattgcgttaaatggtgcatttgctcccagcgtataacaaccaatgtcgctgaatactttgtgagtgggatattcttctttcaatacttgagttaatgctatatacatatctctatgcccgcagccttcgcacaaagccggagggcgcatctctacaagattcggaacactgaattcggaacgattctctttgccgacagcgcgtgccacggtgtccggatttaattctccgtcttgtgacaatgtaccgtcgagacgaccttttacttttaatcctatgcccagatatcccttcagttgcttctcaacgaatggttgtccatcctctaatacgaggatttcgtcacattcattgattaattgcatcaattgctttttgggaagtggatactgcccaatttttaaaacgggatattcgcaaccgtcaggataattttccatcaagtaattatagccgattccacaggctacgatgcccatttttttattggggccatctacgtatctattataaggtgattcttcggatgctttgataaattcatcctgacgtgtaagtaatgctttataacgcttgcgtgcgttgcccggtagcaggataaactggcgtggatcttcactgaatgagatttcgttttgtgctttttgtgctttgttttctacacctgaacgagagtgagccaaacgtgttaccatgcgcattagtatcggttcaccggttttctcggaaaattcgaaaccattgtataccatgtcataagcttcttgttggttgctcggttcgtacatgggtattaatgagaagtcgccatagaaacggctatcttgttcgttctgtgaagagtgcatactgggatcgtctgccgcaactacaatcagtcccccttttacgcctgtgatggctgaattgataaaacagtcagcagctacgttcattcccacatgtttcatgcagactaatgcacgcttgccgacaaaagacatacccaaggcagcttccatagccgttttttcattggcacaccagcggttgtgtatgttacgttcgctcgtgataggagccatctggatgtattcggtaatttcagtggatggagtgccgggataagcgtaaacgcctgaaagtccggcatccagtgctgcttgtgcaatggcttcgtcgccaagtaagagttgtttgctcatatcttattttcttttggtgttaatcacgtattttgttataatatcgggcaaagatacgtttttaagatcattttatcacgggattacttaaaaatctttctttcattcagcgctttccagtattttcttgcattgaccatgtggtctgcatagttggaagcaaaattatgagtacccgaaaaatcttctttggcacacatataaatatagttatgttttacataattcaatacactatcaagccctttgggagaaggtatccggatagggcccggaggaagacccgtattcaggtaagtgttatatggagactgtatgcttaaatgctggttggtaattctgcgcagactaaaatcttgtaaggcgaatttgattgttggatcagcttgcagaggcatacctgtatgtaaacggtttatatataatcccgcaaccatcggcttttcatcgttgttgttagtttcttcttctacaatggaggctaatgtacaaacttcttcaggtgtcattccgattgttttagcttttaaacgtcggtcctcgttccagaatttattatgttcttttttcatccgggcgaaaaagtcttctatgctgatgtcccaatatacttggtaggtttcagggataaaaaggcaaggcatggtagctttcgtatatcccattttctcttggaaagcgggatcgtataacgctgtagcaatttcagtggagtcaatcattaactgttttcctatgctgcaggctaatctgtccagagttcgtacacttccgatggtcaaattgacaggtgtttggtatcctcttgataacctactatataggtggtatgcattatcacccggtttgatagcgtaacgtccggtgtggatgtttttactaaattcacggaaatgggccatccatttaaaaccatcaaagttatgaggatttccttgcttttttattttgttgaaaatagaatctgtagtgtcatcacgatctatataaatataagtggttttacttggatgaaattgaggatagaacaaatagtaataaactattccggaaccagcaatgccaatgaagagaataatagccagtatgctgaaaaatatattttttcttttcttattcatatagaatattcactatttataaagttgtgccaaagttaagaagatttcaaagatgtttgttcttggataataaatgttttctgtctgtttagttattatttactttttaggggtatttactttttcatttttagtttttgatatacgcttttgttcccgttcatattttccacaaagcgatatttgtttggctctctagtttattttctaaagaatcgggaagaggagaaaagaaatctaagccggtgagctgttcaacgctgtcaactgagactgcataatttcgtagtggttttgttgcaggttcgttgttgaaaacaaatccaatagctttggggggagaaccgtaaagagaaaggatgaccttgaaaaatcttgttggtacggttacctggttcttgccgattgtatgggattctttattcattatcggaccgcagacaatgaagatggaactgtcggctactgcccactcacgtactttatcttccaagtctttccattttcgccggtttaattcggggtgttgcgggcatatattgctgaaatagaaagactctttcatagcttcgttactccacttcatgtcggcagcgggggccatatgtcccttgtcgaatccggaatgtgaataatcagaattagttgccatattgcctttgatagaaggatcggcgaggaattgattgtttctttgggcatttccctttgtttcttgtcgagtgagttcataagctacccagtttggaatcttttggattgtattataagatacagtgtatcccttgtgacaaaccagctgtccgtttagcgagtgttgagaaattggaatctccagattctcataacgtaaacagttaggtacagctttctcttttgattcctttgttgtctgaaagagggtagtctgaatctccggtatgcaaagatagattccataaattaaaggtaagattgcaaatagagctattccgaaaatactcttaaacgaatttctatgatattttttagacgacttttttcgcttgtttttcatgatattgaaaatttaaagcttgaaatttcgagtaatatgtgggtacgtaggcattattgtattccaatgattattgttagcagctattgtatggataaaattaaggtgtaacaggtatttatatacaagttacacctttgggataataaaagagccgctagccagacttgaactggcgacctacgcgttacgaatgcgttgctctaccaactgagctatagcggcgttgcattttatcgtttacggcgtgcaaaattacatctttatttttaaaaacaaaatgaatctatacttttttcgtgatattttctctgaaatgtttataaaataaaaaggttgaggattaaattagaaaatagttgtagattcaaatattaaaactcatctttgcatatttactgataaatctacttttatattactatgaatatacgattttattataagtatctttcatcacgagttgcttcaaaatggctgatacttgctgtcgatgttcttttagtgattttttcaatgtttttggcgagccttttgcaaataggtttgtctgtgttagtttttgaattctcactatgggtgtggacaactctattctgcgtaatatgtaatgtgtgtttctttcatctgaatcgtacttatgtaggagtaattcgctattcttcctttattgacatttctcgtatttttatttctttaactctgggctattttgttgtttgtatcggcaatttgctttggatagggtggagtggaggagaagttctgccgattagtgttattcttacagcttatatagttaatttttccttgatggtttgtttgcgaatcttggtgaaaatgatacatgagttgatgacttttgatcgtaggcacagtattcgcgtttttgtctatggttcaaaagggtctggtattaatattgccaaatcgctacgggttagtagaagtaatcattttagattgaaagggtttatttctgatgatacgggatttattgggaagcaaacaatgggttgccgggtatacgcgaataatgagtctttgtttgatatattagaagaagaaagagtcgaggctattattgtttcttccgagaaagtacatcgtcttgaaacttccggcatgattgatcggttgatagctgaagatatccgtattcttacagtacctcctatcaatgatcttggaaggcaaggcgtgcaaataaaagatatacagattgaagatttgttacaacgggatccaatacatgttgatatccggaaaatatcttcacacattgaagggaagcggattatgatcacgggagctgctgggtctataggacgtgagatggttaggcagatagcggggctgaacccatataagttgattttggttgaccaggcggagtctccgttacataatgtgcaattagaattactggataattggcgggatattgatgctaaaatgttggtggctgatgtaactaatcgaacgaggatggagtatatttataaggagtatcggccgcaatatgtttttcatgctgctgcttataagcatgtgccaatgatggaggataatgtgtctgaagcgatacaggtgaatgtattgggaacttgcattatggccgacttggctgtgaaatatggcgtagataagtttgtgatggtttctacagataaagctgttaatccgaccaatgttatggggtgcagtaaaaggcttgccgagatctatgttcagtcccttgctcgtaagttatctaaatatgcaaaagatggggcacaagtgaagtttatcacaactcgttttggaaatgtactcggatcaaatggctctgtaatacccagatttaagcagcagatagaaaagggtggtccggtgactgtgacacatcctcaggttatacgttattttatgactattccagaggcttgtcagttggtattggaggctggaagcatgggaaatggaggtgaaatctatatttttgatatgggtaatcctgtgaagattgttgatttggcgcgaagaatgatttatttaagtgggcagaaaaatataaaaatagagtttaccggattaagacatggtgagaagctgtatgaagagttgctgaatgtaaaagagtctacttgtcctacttatcatgaaaaaataatgatagcaaaagttcgtgaatatgattatgagaagataaagcaagaaattcaaaggttaatagatttgagttatacttccgacaccatgggcattgttgcttctatgaaaaagatcgttccagagtttgttagtaagaattctgagtttgagatattggataaagcctctttttaatctattttcgaaaacttaggaatgaaataaatgtatattatgaaaataatatgttacctttgtgcccggtttataatttattagaggaacactaaagattaatcagaatatcttatgcgtagatttattacactattcttcttgatttttaccttatccggtgtagctgtagctcagcaaatgtccgatgatcaggtcgtacagtatgtaaaagatgctcaaaagatgggtaaaactcagaagcagattacaacagagttgatgagaagaggcgttacgaaggaacaggtcgagcgtattcaggaaaaatatgaaaatggaaatggtagtacaagtacacagagtaaccagaatacaacaaggtctcgtacacgtactcagcaaaatgatgaaagtgactattcgaatcgttctcagaaaaacctgaaggatcagaaaaatcaaaagaatcagaaaaatataaaaggtctccgtcaatcggctaaccagaaaaataaacggggtatgggcgatgataatcaggaaatgactgatgaggacatgatgtatgaagaggattggtctgatgaatatatgatgaaaccggaagaggatccgacacaacagatttttggacataatatcttcactaacgagaatcttacattcgagcctaatgtaaatattgctactcctgtaaactatcgcttgggtcctggagacgaggtgattatagatgtttggggagcttctcagacaacaataagacagactatttcgccagagggcagtattttagttgataatctcggtcctatttatttaagcgggatgactgttcgtgaagctaataatacggtgcgtcgtgaattttcaaaaatctatgccggcatttcaggtccgaaccctaacacctctgtcgatttaacattggggaatatacgtactatccaaatcagtattatgggagaagtggctataccgggcacttatgcgctctcggcattctcttctgtattccatgctttgtatcgcgctggtggcgttaataagatcggtagtctgcgtagtatcaaagtcgtgcgtaacggtaagaaaatagccgatttggatgtttacgattttataatgaaaggtaaattgaatgacgatgtccgcttgcaagacggtgatgtggttattgttgatccttatgaatccttagtacaaattactggcaaggtaaaaagaccaatgttttatgaaatgaaaccttccgagacgatggctactattttgaaatactcaggaggattcactggagatgcttataagaaagctatacgcctgattcgtaaaacgggtcgtgaacatcaagtatataatgtggacgaaatggactattcggtatttaaactggatgatggagacgttttagctgttgattcggtattagaacgttttgagaatcgtgtagaagtccgtggagctgtttatcgtgccggtatgtatcaaattgatggtactgtaaatactgtaaaacagctaataaagaaagctgaaggggtaagaggagatgcttttttgaatcgtgccattatcgatcgtgaaaacgacgaccttactcatgaaatgattcaaattgatctgaagggattgttgaatggcacagtcgctgatattcctcttcagaagaatgatatactttatattccaagtattgaagatttgaaagaagaagcgacacttactattcatggcgaggttgccaatccgggtacttacttatactcgtcgaatatgtcggttgaggatcttgttttgcaggccggtggattattagaagctgcttcaacagctcgtgttgatgtgtcccgtcgaattaaaaattcaaaaagtacagaattgagcaatgtggttggtaagactttctcttttgagttgaaggatggtttccttgttggaggcgatcaggatttccatttggaaccttttgatgaggtgtatattcgtcgtagtcctgcttatcatcaacaacaaaatgttacggttggcggtgaagttttatttggtggtcgctatgcgttatcgaaaaagaatgaacgccttagtgacttgattgccaaggccggtgggattacccaagatgcttatgtaaaaggtgcgcgtttgattcgtaaaatgactgaagaggaattacggcgcaaggaagatgcactccgcatggctaataaaggtggggctgattctatctctgtcaagacactggatgtttctgatacttattctgtgggtatagaattggaaaaggctttggctaatcccggatcggactttgatatggtgttgcgtgaaggtgatattctgttcgtgccggaatatgtaagtacagtaaaaatcaatggcgctgtaatgtatcctaatacagtcttgtataagaagggtgaaagtttgaagtactatattaatcaggctggtggttttgcaagtcttgcgaaaaagaaaagagcttttgttgtctatatgaatggtaccgtttctcgtctgcgtacaggtaattccaaggcaatagaaccgggatgtgagattattgtaccaagtaaggatccgaagaagagaatgtcggcagccgaaattataggaatgggtacttctgcggcttcattagctactatgattgcaactatggttaacctttttaagtaatgactatgactgaagataagaatataaataaaacgactccacaacctgaagaacaagagatcgatttaatagagttggctcagaaagtttgggctggtcggaaattggtatttaaagtttgtgggattgccctgttggtaggccttgtggtagcttttagtattcccaaagaatattctactagtgtgacgctggcgcctgagactggtagtaagtcatctacaggaggtatgggagcattagctgctatggctggtatcaatattggcagttcaagtggagaagatgctctttctcccgaattatatccggatattgtcagctctacgccattcttgttggaaatgtttgatgtaaaagtgactgaccagaaaggcaaaattaatacgactctatatgagtacttggataaacatcagcgatctccatggtggggggcgattgcatcagctccttttaaagcattaggttgggtggtttctttgtttaaagatacaccggaagaacttggagacgcaaaaataaatcctttttgtctgactccggatcaggctgggattgcagatgctttgagtcatcgtatatctgtttcagtagataagaaaacaggagtgactacactttctgtaacaatgcaggatccgttaatttctgcagctttaacagatacagtaatgcattgcttgcaaaattatataactgattatcgcacaaataaagcgcgtcatgatttggcttttacggagaaactatttgatgaagctcaggggaactactatgaggctcagcagaaatatgctcacttcatggatggcaaccagaatatcattatgcagagttttcgtacagagcaagagcgcttgcaaaatgaggtaaatttggcttatggagtgttcactcaagtggcgcaacaattgcaagtagcgaaagctaaagtacaggaaattactcctgtttatactgtagtacaacctgcaacagtccctttgagaccggctaaacctaataaaatcatgattttaattggttttgtattcttagcgggtgttggtagtataggatggattctctttgttaaagatttattgaacggatggaagaaacagccagaaaaataaaagaaaatgcttcttgttggtatgctgtatatacggcaccaagagcagagaagaaagtgaaggaacaactggataagataggtattgataactacctgcctcttcagccagtgattcgtatgtggaacaatcgtaagaaaaagatttttattcctgttgttccgggatgtctatttgtatatatctcctctgaagagattgcacaaataaccagtattcatggagtagcttttttgctgaaggaaaagggacaatacgtttctatacctgaggtgcagatggaaactttcagaacgatgatagaacgttcccatgaattggttgagttcgcgcctacagattttgttccaggatctactgtacaggtgattcgtggacagttgcagggattagtggctgaattagttgaatgtcagggaaacaataagtttttacttcggattgaagggttgggatgtgctttggctacagtatctgcagattgtgtagtatcaaaagaaaaacaatgaaactgattaccgaagaacttcttgatagagtaactgatcaggctaaggagaattcacgtcttcgaatgaattataatttccatgaatccatggaagctgctattcataggatgttgaatgctttagagcctggaacttatttgccccctcatcgccataaaaacccggataaggaagaagtttacttggttttacgagggagcttattggctattttatttgatgatgagggtaatgtaatggaaaaggtcaatctgaatccgactcaaggtcgttatggaattgagattcctccttgcgtatggcatactattattgtcttggaatcaggaacggttatttatgaaattaagcagggaccttttgtacctcttactccggagaatctggcatcttgggcacctccagttgctgacaaggaggctgcccgattatttatggagcgaatgcttgagttttaacactcaaacattctgcttcttgcaagcatgcaagctcctacgatacctgccctgtctttaagttttgatgttacgattgctgagtctttgtttactaaattaagtgaatatttgcggacggcggtttttataggttgggtgatatagtcacctgtaagtgaaattgttccaccgataatgacaagttctggattgaagagattgataagtccggcaatttgttttcctagtttctgcccaatttcttccactatctcaatacacaaaaggtcttctttgtttacagaagcaatgatttcgtccagtgttataggattattgacatctcctatacggctggataaaatagagttttctccgttttgtatacgttctaacaagatacggtgtagtgcggaaccagaagcttcggtctcaagacagccttttttgccacaatgacaaatgatttcattatcaaaagtgctggtatggccaaactctccggaaaatcctgatttgccggtataaattttgccatcgataataattccaacacctaatccccaactgatatttacgaaaataatatccttttcaccgtttacgcatccctttagatattctccataggtcatggcgcgtgtatcattgtctatagtgaccttatatcctaatttttctgccaagacttctgataatggacgttcctcaaagttaaactggctgaaactatatccggactccgggttgacacgacctgaaacgtttacattgatattcagtattttctccttggctattgtcagtttctttatgaagtttgaaatgagtttgcataattcattcaatccctctattgaattctcaaatttataagggatattcattttaagttccatcatgtcgcccttgaagtttatcaaaccgatattaatagcaaatcttttaatatcaactcctatgaaataaccggattccgggtttaggccatataaattaggatggcgccctccacttgtttctaatttaccgtagtcgttaatatagccttcctcacacatttcactaataaattttgtaactgtggggacgctaagatccaactctttagacaggtcagtaattgttgaactgccattatatatataatgtgtaataattttctttttgagaagagcgcttttggttcctagttctatttcttttaaaagatgttgtttcatatagattaattattttggtaatatctacaaagatagttaatttgtttattaattcaggtttttcagggtgaaaagatgtttctctattgtttttaattgataataatagtgaatgaattttattaagcggatgtttgaatcttttttttattaataaaatattttattatatgttgattgtttaataaatatgcgtatatttgtaccgatatgctaaggatattacgagtgtattatgaaaaactagttcctaatccatattaaaattctatatcattaatataaaaacgaaattatcatggaaaagattattggattgatcaatgctccttttactccgttttatgaaaatggagaagtaaattatgaacccattgaagcatatgctaagatgttagtaaagaacggtctgcaaggtgtattcattaatggatcttctggtgaaggatatatgttaaccgatgaagaacgtatgaaactcgccgaacgttgggtagaagtttcaccggaaggatttaaggtaattgtacatgtaggtagttgctgtgtaaagtcaagtcgtaagcttgccgaacatgctcagaaaatcggtgcatggggaattggcgctatggctcctccttttccgaaagtgggtcgtgtcgaagaactcgtgaaatactgtgaagaaatagcctgtggcgctccaaatcttccattctattattatcatattcctgcatttaatggagcattcttatcaatggtttcatttctggaggcagtagatggacgtattccgaattttgcgggaattaaatatacttttgagagtatgtatgaatacaatcagtgccgcttgtataaaggaggtaaatttgatatgctgcatgggcaagatgaaaccattcttccatgtctggctatgggtggtgctcaaggcggcattggaggaactaccaattataatggtgtaaatctgattggtattatagaagcatggaaagccggagatcttgataaagcgcgcgaattacagaatttctctcaggaagttattaatgtaatctgtcatttccgaggaaatattgtaggtggaaagcggattatgaaattgataggattggatttaggtaagaatcgtactcctttccagaatatgacagatgatgaagaaatacgtatgaaagctgagttagaggctattcatttctttgatcgttgcaataagttttaagataaactaatactgcaattgctatgaatactacagaatatctacagacatggtctgactcttataaaaatgacatgataagcaatatcatgcccttttggatgaaatatggttgggatcgcaaaaacggaggtgtttatacctgcgtagaccgagatggccagctgatggatacaaccaaatctgtttggttccaagggagatttgcttttacatgttcatatgcatataatcacattgaacataattcagaatggctggaagctgcgaaaagtacccttgattttattgaagcacattgtttcgatacagatgggcgtatgttttttgaagtgactgaaacgggtttgcctattcgtaaacgtcgttatgttttctctgaaacatttgctgccattgcgatgtcggaatatgctatcgcatcgggcgatcataattacgctgttaaagccttgaaactgttcaatgatatccggcgctttctttctactcctggaattctggaaccgaaatattgtgaacgcgtacagatgaaaggacactctattattatgattcttattaatgtagcttcacgtattcgtgctgctattaatgatccggttcttgatcaacaaatagaggaatctatagccattttgcgtaaagacttcatgcatccggagtttaaagctttgcttgaaacagtaggtcccaatggagaatttattgatacaaatgctactcgtaccattaatcctgggcattgtatcgagacttcgtggtttattcttgaagaagctaagagtcgtaattgggataaagagatggttgatacagcgcttacgattcttgattggtcctgggaatggggttgggataaggaatttggaggtattataaacttccgtgactgtcgaaacctgccttcgcaagattacgcacatgatatgaagttctggtggccacagacagaagccattattgcaacattatatgcatatcaagctactaaagatgaaaaatatttggctatgcataaacaaatcagtgattggacttatgcccatttccctgatccggaatttggtgaatggtacggttatcttcatcgtgacggaacaatttctcagcctgcaaaaggaaatttgtttaagggaccattccacatccctagaatgatgacgaaaggctatgcactttgtcaggaattgctgtcagaaaaataatctcttatttatatcatgaaaaactcaaaaatttatccttggatagtggttgccctcctatggggggtagccctactcaattatatggaccgacaaatgcttagcacgatgaaagatgctatgcaagtagatattgtagaacttcagtcggcaactaattttggccgtttaatggccgttttcctttggatttatggtcttatgagcccaatttctggtatgattgccgatagactgaatcgtaaatggttgattgttggcagtctttttgtttggtcttttgtgacctatttaatgggagttgcagaaacatttaatcaagtcttttggttacgtgcattgatgggagtgagcgaagctctttatattccggccggcctttctttaattgctgattatcatggtgaaaaatcacgttctttggcggttggtattcacatgaccggactttataccggacaggctattggtggctttggcgctacggttgcggctgctttctcttggcatactacttttcattggtttggtattattggtattgcatatgcctttgttttggtattatttttaagagataaaaaagagcatgttaaagtagaacgtccggaaccttcatccaagaatggcgagaaagcaggtttgtttaaaggcttatcattactattcagtaatatagctttctgggttatattgctttattttgcggctcctagtttgccgggatgggctactaaaaattggcttccaactttgtttgctgaaaaccttgatattccaatgtcacaggcaggacctatgtcgactataacaattgcactatcttcatttattggtgtaattttaggtggtactctttctgataaatgggtacaaaaaaatattcgtgggcgtgtatataccggtgcaattggtttgggattgacgattccctctttgttattattgggatttgggcatagttttgttgctgttgttggggctgggttgttattcggtatcggctatggtatttttgatgctaataatatgcctattctttgtcagttcgtttcttctaaatatcgtgcaacagcatatggcatcatgaatatgacaggagtatttgcaggagcatttatcacagatttgctgggtaagtggaccgatggtggaaatttaggtttaggttttgccatgttggctatcattgtatttatagcactggcagtacaactctacttcctgcgtccgaaaacagataatatggaataaaaataaaaggaaatgattgtatctaatttacagaacagccaaagggtagaaggacttcacccactgtttaaaactctgtttgattacgtaaaaacacatgatttacttcatgccgaattaggacgaattgagatagatggtgataacttatttattaataatgtgaatcctgagtgtgttacacgcgataaacaagttttggagttacatcgcgattacattgatgtacatattttgttggaaggaacagagactataggctggaaagctattgaagatctaaagagtgaaatgaaaccttatgcggcagaaggggattgtgctctttactctgatgtgcctactacattcgttgatttgctcccgggacaattcatgattgtatatccggaggatccccatgctccccttatcggacaaggtaagattcgtaaacttatagcaaaagttaaattgtagtttgttaaacgcataataaaaaaacgtctggattgttaatattaataatccaggcgttttttattatagagctgttatgtaaatttctatcatcattgatttgatagatgtttattttttctatgcaaatgggagaggagagagtttcttattataagattctctctcctctatttatatattgcttataatcagtgttattatgttctatataaggtaaatgtctttttagagagaatgactattatgatactgtcttttaatagactaaatatatgcattatgtatttgcatctaatttataaatgtgattataaataattgattaatagtaatataatgtttctccctatttaatgctttgagagtaataatgtgctggggttccgatagaacttagcaaacagttttaaaaacacatataaacatctttattattaactcaaaaagcaatacttatgaagaaaaccatcttcttgattttgtgcttgttatgttccatcggagccatggcgcaaaagaaatcaatcacaggcgtggttacggatgctagcggtgaaacagtcatcggagcaagtgttgtcgaggtaggtaccaccaatggtgtaataactaaccttgacggcaagtttacgttaatggtcgatcccaatggaaagatcaaagtatcttatgttggttatcagcctcaagtaatcgacgtaaaaggcaaaaattcttttaatattaagttgaaggaagactctgaaatgctggatgaagtggttgttaccggttatggtggtaaacagctacgtacgaaggttacgaactctatttcaaaagtaaaagaagaatcgttaaaagtcggtttattctctaatcctgcacaggcattatctggagctgttgcaggtttgaaggtaacacaagcttcaggtagtccgggagcaactccaacaattgtattgcgtggtggtaccaatcttgacggaacaggatctccgttggttatgattgatggtcagcttcgagatgggttgaatgatattaatcctgaggatattgaatcaatggaagtcttaaaggatgcaggtgctaccgctttgtatggtgcacgtgccagtaatggtgttatattggttacaactaaaaatggtaaagtcggtcatcgtgaaataaactttaaagcaaaattaggtcttaactatgtgaataatccatatgaattcttgggaggtgaggattatatcaacgttttgcgtactacctatgctaaatctggctataaatgttctgatggtgaatacgtgtcaattgctccattggctaatctaacaggtgcctcgccttttggtacagggaatgtattaggtaaatctgcttggaatattatgggaaaaacagcagataatgcttacttgctgcagaaaggctggaaggaaatggttgatccattggatccttcaaatatgattatttacaaagttattaatcctgccgattataatttaaataatccttctttctcacaagattataacattaatatgtcaggaggaaatgatcggggaaattattatgccggtctggggtataaccgtcaggaaggtcttccaatcagtactttctatgaacgttatagttttgtattaaatgctaactataaaataacagattggctgacaagtacttccaatttcaactataatcgagccaactggaaaaacatgccgggatcaaatggaagtgaaggaaattattttggtcgtatcatgtcaactcctcccacggctcgttttgaagacgaagatggaaatccgactttaggtcctaacgttgctgatggaaatcaggcttttcaacctgaaaaatggcaaaactttaatcaaacagataaatttaccatgattcaaggatttcagattgatatcatgaaggggttgtttatcaaaggtacagcaaactggtattattcagaaggcttatatgaatctttcactaaagattatatggataatatgttgactgaacactacactaaaactcgcgaaagtaccgccaagtttgaacgtaactttgcgcaaacgtataatgcagtcctgaactttactcatacttttgccaaagatcataatgttaatttaatgttaggtatggaatattatgataactacaaacgtggatttgaagcaaaaggaagtggtgcaccgacagacgatttctctgatctgagtttaacagataaaggagagggaaaacgtactattaattcctggcatgaacaatatcgtattctttcatatttcggccgtctaaattatgactataagagtaaatatcttctatccgcagtattccgtcaagacggttattcttctctattaggtgataaccgttggggatttttcccaggtgtatctgccggttggattttcggtcaggagaattttataaaagatgccattccgttcttgtcatttggtaaactgcgtgctagttatggcgttaatggtaatgcttcaggcattggagcctacactttacaaggttcttataatacagcagtatataatggaaatacaggttttctaattggaactttacctaatccgggattgagatgggaaaaaacaaaaacagctgaagttggtatggatctgagtttctttgaaaaccgtttgaatgcaaactttacctattataatcgtttgacatctgataagtatgcagatttcagtttaccatcaacaaccggtttttcctctatcaaaaataacaatggaaaattccgaaacagtggtattgaaattgaactatctggaaaaattctgaaaacaaaagattggagttgggaagcatccgcaaatatctcatttaataagaataaagtagttgcattaccagaaaacggtctggaactcaatcgtcaaggtggacaacaaatctatacaggagaaaagttcactaatgaaaaaggtgaaatagagtatgcaaaaaaatgggttggcggctatcaggaagggaaagagccgggagtaatggtcgtttataaatcagaaggaatttatcgtagttgggatgagattcccggggacttggttatcacctccggtaattattttggtaaaaaaatgtatggtcctgaagcatggaaaaaactaaccaaagaacaacaaaaaagtgctttgcctattatgccgggtgacatgaaatggaaagatattaatgaagatggaatcattgactcttatgatcaagtcgtagcaggtaatacaactccccactggatcggtggcttcaacactactttacgctggaaaaatttccaactttatggtcgttttgactttgctttggactattggatctatgaccacactttacctgagatattcttagcttgtgctcaaggtacttataatacaactaaagaggtattcaatacttggtcagaagagaatcctaatgcaaaatatccccgttatgcatatgcagacgtcttaacgaatgctaattatgcacgaaattcaactatgtttgcttacaagggaaactatttagctatcagggaaatttctttgagttattcacttcctaaagcatgggcaaacaaagcatattgccaaaaagtagatgtgtcaatcaccggtcaaaatctgggatatataacttctgccaatgtagcaacacctgaggtttctaatgcgggttcaggctatgcattgccgagaactctcttatttggacttaatgtaacattttaagtaattaattactaaatagaataaatatgaaaagaataaaatctacaatattatatagcctactggcagcttcttccggagtactttgtacttcttgtgccgataaattagatctttccccgattgattactatgggagtggttcatattggaaaacagaagcacacgtaataggatatatggatggtatacataagcatttacgtgatgcggcctttcagcatacttttatttggggagaagcccgtggtggtgctttaataagttccggtactagtgccgatggcatgggtatgttatatggtgacataaaattacagaattttgacgaagaccatactggaggcattaataaatttggtgatatttttgggcggttgactaatataaacctctttatcgccagagtaacggatgccacctatatggacgataccaaaaaaggatattaccttggacaagcttatggtttaagagccttttactatttcgatttgtatcgcacttatggtggtgtacctttacgtctctctgcagatgtagtagaaggagttattgaccccaataaactatacatggcgcgtgctactcccaaagaagtcatggatcaaataaaaaaagacttggataaatccatggagtattttggtgataataactcatttgatccaaataatcgtggaaataaaaagggatattggtccaaagccgctactgagtgcttgatgggtgaggtttatctttggatttccaaggtatctactggagatgattctgcgaatgaatcgaatctgggaatagcaaaaacacatttgcaaaacgtcttgagcaattatggactgaaaatgttagatgacttttcatcagtattcgatgccaaaaatggaaaaggaaattctgaaatcatatttgcagttagatatgcagaaggtgaggccactaataacaataatttgttcacctatgcaatggctactggaagtactaaagataattatttagctaatggtgaaaaatttcttgatgcattgaatattgccaatacaggtagtcagcagttggaatataaacatgaaatttataatagttttgatgtaacagatacgcggcgtgaagctacatttattgcttcgtataataaaaatgttgagacaaatgagctgaccttaagaggaacgcatgttcgtaaaaacattggttatgtgaatgctcagggaagccgtatctattgtggtgattatattatttatcgcttgccacttgtctatttaatgcttgccgaaattgagaatatgcaaggaggaaatgttgctcaatatattaatattgttcgtaaacgtgcttatggcactaattggaatgaggcaatatacggatataaaaactctgattatacaacaaatgaattagcgattcttcatgaaaaagataaagagttcattcaagagggacagcgttggtgggatattcgtcgcatgacattgactaaaggaggaaaacatctcgttttttgtaaagagggaagcattggaacagatacgcctactttagacgaaacaactgaggctcataaagtgctttggccggttgacaaaaccttattgggtaatgatcctttgatttatcaaactccggggtatgctacttataaaaaacaagaataggtattattaaatacgattaatcttaattgccaacatgccgtgtactttgtttagtatacggcatgtcttttgtccgtccattaagacgagacagagctcgataactatctatctgcataaaggtagattccgtttatccgtcctctgatttgaataatgacaaactgaaacaggcgaaatatcccactttggtggagtattacagtaaattgtatcatagataaagaatcgccatgtaccgaacagtatacatggtgatatgagagggcggataacaaaattcttttcttcctgtttttgttttccgtctcctcaattaaaattgattgtttatttaggtttcaattactacatttcatctttcttccaataattctctcaaccatggtacaaccagttctgatttaaaataatgattgggaccatctacatttaccattcgaaaatattcattacgatccagtccttcaggtaagtgttttacattttttcgtgtatttggatctgcgaatttcttataatgatatactttcacgttatcgggagcgcctgctatagcatacgcttttcttacaagattcaagtctctatctaatcccccttcagtcagtatgataggacggggtgccaaagctgctacaatgtctggaaaattgaaatttttccaaaaatcaggtattaaatgacgtatggaattagggaatggacggcgtccgtttttatcaggcatagttatcacttccgcccgttcttgagtttgacataagaaatcattgtaaacaaaagcataaattgaagtatcaagcgtacccaataccatcataggttcggttcccaaagaaaatccacttactacaatgcgatctttacgaatatgatcctgggtcttcatccagtttaaaacctgcatatccaaatatgaagcgtatcccaaatagctccatcccaattctaaaagatggcgagatacaacatcgtaatcataattagagcccaaagtatatctctccaggtctgaggcttctccggcagccgggttatctactgctaccgctatatatccttcttttacaaagttgagggcttgggtcagtttcggatctttgtaccggtcgtccaattggggagttatccccggttcacctgcaagtccctccttatttcctccggaaccgggaatacataaaatggcaggtacgggtttatttatattatcaggtattaaaacaagaaaagtagaaacgcattcaggaagcggataaaattcccatttttctaatcgataaccttcccgctgttctctttttatacaaacaggagcaggagaattttttatttgaggaaatttcattatttcttccatcgcatggcgaagtcctttttgccattttcgaaattgtttgggagagaagtcatcatgaaaagcataacatggcttagtatttctgagcatagcgtgcactacaccataagagcttaaaaatcgcccgtcctcacgtgcagacgtgattaaattatgatccttaggagaccagccatcggactgagcatataggctgccattaaaaaacagtgatattccaattattaaaaaaatatttttcatgtgatttaaattttatagattttacaaatatagttttattttttgatatgctccttttaattgctgaaatatacaattggacatatagtaagtgacagtataagatatgatgcaaaaagatagtattttatttgtttgagaatcctgtaatattatctcctatcctacaaatagaagataatatgaataaattgaggaataatatactgtattggcaaaagtaatgtatataaattcattactgctaccggaagatattaactggctaaaatcagaatgttaactttgtgttttcaagaagttaacttcgtacagatacgaaattaatttcttgaaaacaagttgttagttctctgtcaacagacggtctaaatcactgctaagagtgtgaaaataatcttttatatgttctatttgacaatgaaattaagaaaaaagaaatatgtggctatgttccttttttgaaatatctctatgcaaaagtaaatcgtaagtcggtaaaaatatgctttttgatcgtagaatcgtgatttcacttttcctttgatttgataaaacggttcagattttgttttttctattccggttcctctcatccctctgattagcacgatgtagagacatcaagaaatacaaaatgtcagatctgtaccaatatatcaaattgataaaagggggattcaaaaaacaggctgctccatagcgagatacttttatcattttactaatgaacatttatctactacatatcctctaatgataaacagactgtatttatttggtatttagccaaaactttattctctaagtgctccactttcttttggaaaagttctggtttgaaattctttttttgacgtttgacttctgctacaattgcacttttgttatctaaataaatagctacaatgtcaatttcgttttgattgcctttgggctcccaccacgaaccaataagacggaattcataactttcagcatatttttgcttaaaatactgttccaggatttttcctgaatatgtcggatagtcagcttttattaattttcgtaagccaacgaaattttttatttcaatgagtgaacgatttctatcgaaataattaaaccagaaatgaataaagttatcgcatatttcatatctgacagtttgagaaccctctttagaaaagacaggacgttggcgtactactatgttataatcttcaattaatcgctttagataaccgcccagactcttttcgccaagtagtgcttctatttccgtctgagtattatacccgccagagatggcgctcaggattgagaagtaagtaccgtaattcttgccgaattcctctattaataaattttttccttcatctgtaaagggcgagttgtctctgaccatgaaatcaatcatttcatcaacggttaacactctgttatcacaaaataattcgacgtatttaggaactccaccagaaaatgagtataatgccaataaatcatcatttgtatattggggatgatagtctttcatgatcttctttaatacattcagactaaaagcagaaagttttataatgttgtcagcacggccaaaaagcggctccttttcattatgaaaaatcttttccattaaagaataaatagagccactcacaacgaaattcatgtgggttttttgtctatactgatcccagatatcttgtatatcactataaattgacttattgatattatagaattcttggaactcatctataaccaaattgaatgattgtctagtagcagcttccattatataccgaaagagggatttgaaagtcgatatttcttctggtacataaatatcaagtgcctgggaaactaaggttatgaattcccgacatagagatgcttcattttttctccccacaaacaaatagatagtaggagttttttcaaaggctctcataataagacttgtcttacctatccttcttcttccggtaactactgttagacgagagttctctccaaaagataattcttgtatcctttgtaattcagctaattcattctctctattgtaaaatttcatattctttgtttatttagtccttactttgtaacgggcgttactgtaaccgcggttacaaagataactctatttctattatttcaagtacaatgtttcataagatttctctgacgctttgtataataatgttaatagctaattgtgttcttttcgatatgccaatttatatatgtcaactattttaaactaacgtcttgtctattatgatataagttaattatgaagattatatttataatataaccttatttgtttgtcatttatacccttatgctaccgctaatatttataaataatgggtctatttttttcttttttataattatgtgaattatttaaattgctgtatgttagctgtttattaaatgtgcttattattccatttctccacatttgggttaccgtcccgatagaacttagtaaacagttttaaaaacacatataaacatctttattattaactcaaaaagcaatacttatgaagaaaaccatcttcttgattttgtgcttgttatgttccatcggagccatggcgcaaaagaaatcaatcacaggtgtggttacggatgctaccggtgaaacagtcatcggagcaagtgttgtcgaggtcggtaccaccaatggtgtaataactaaccttgacggcaagtttacgttaatggtcgatcccaatggaaagatcaaagtatcttatgttggttatcagcctcaagtaatcgacgtaaaaggcagaaattcttttaatattaagttgaaggaagattctgaaatgttggatgaagtggttgttaccggttatggtggtaaacagctacgtacgaaggttacgaactctatttccaaagttagtgaggaatcattaaaggttggtgtcttttctaatccggcacaagcgctatcaggtgcggtttccggtttaaaagtgacacagagttccggtaatccaggaagtacaccgaccattgtactccgtggaggtacagaatgggatggatcaggttctcctttagtaatggtcgacggacagctccgtgacggtttaaatgatatcaatccggaagatatcgaatctatggaagttttgaaggatgcaggtgctactgcattgtatggtgcacgagccagtaatggtgtaatattgattacaaccaaaacgggtaaagccggtaaggcggaaattaatcttaaggctaaggtaggtatgaactacattaataatccctatgattttctaggagctaaggattttatcacagctttacgtacagcctatgatacgacaccatgggccagtaaatcatcattggatggtgcctccgcttatgggacaggaaataaatatggcagcgatttggtttggaatttactggtaaaggacaacgaaaacgaatttctattgaataaaggctggcaacaaatgcaggatccgcttgatccttcagtgacccttctttataaagatatcagaccctctgattataatttgaataacccttctctaactcaggattataatgtaaatatgtcaggtggaaatgataaaggaacttattatgctggtttagggtataataaatcagaaggacttcccatttcttctttttatgagcgttatagctttattttcaatggcagttataagttggctgattggattaccgcaagttctaattttaattacaatcgtgctaattggcgttctatgcccggttcgcaagataatgaagggaactattttggacgtataatgtctttaccccctactgttcgatatgaagatgaagatggaaatcctgttctcggtcctaatcatagcgatggaaaccagtcatatcagcctgaaaaatggcttgtagataaccaaacagataaatttacaatgatccaatcgttggaaatcaggccaatgaagaacctcgtaattaaaggtaccgccaactggtattattcggaaggtgtctatgagagttttaccaaagatttcgaaacagctccgggtaaattcaatacaactagatcttcttctgccaaatttgaacgtgacttctctcaaacttataatgtggtactaaattataataacacatttgctcaaaatcataatatagatgtcatgttgggttctgaatactacgataaaaagacaaaaggatttagtgcggcaggttccggtgctcctactgacgattttgcagatctcaacctgacagataacggggaagggaagcgcacaattgattcatggcatagccagtatcgcattctttcttattttggtcgtttgaattatgattatctggggaaatatctgttatcaggggtgttccgttatgatggttattcttcgttgcttggggataaccgttggggatttttcccgggagtatctgccggatggatttttggcaaagaagacttcataaaaaatgccgttcctgatttgtcttttggtaagttacgcttcagctatggtgtgaatggtaatgcaacaggtattggagcttatactttacagggttcttataattctcaaaaatacaatggtaatgtaggatatctgattggctctctccctaatccgggattaaaatgggaaaagacccgtacaactgaagttggtatagacttaagcttctttgataaccgactgaacgcaaactttacttattataaccgtttaacgatggataaatatgctgatttgagcttgcctactactaccggtttttcatcagtaaagaataataatggagattttcgtaacagtggtgttgagatggagctatctggtacaatactcaagataaaagattggacttggaaaatgggaggtaatatttcgtataataaaaataaagttgttaccttaccgaacaatggtcagccaaagaatcgtattggtggccagcaaatttataccggacgtaaagttttagatgaagcggggaatcaagtagatgaagtaatttttgtaggtggcaaacaagaaggacaggaaccgggtattttagtcggatataaagcggaaggattatataaagattggaaggatattcctgaagatctggtcgtaaaaacaggaaattatcaaggaaaatatcaatatggtccgaaagcgtatgctgcattgtcagatgcagaaaaagcgaaagctcttcagattgaacccggtgatgtaaaatggaaagacattaataatgatggtatgattgatgcttttgatcagatagtaatagggaatacgactcctcattggttcggtggtttcaatactacattgacatggaaaggtttgacgctgtatggacgcttcgactttgcattggactattggatttatgataatacgactccttggttcttgggatgtatgcaaggtggatataatacaacaaccgatgtattcaatacttggagcgaagaaaatcctaacgctaaatatccaagatatgtatgggccgatcagttaggcactgccaattattatcgtacctctaccatgtttgcttataaaggaattatctggcaatccgtgagctctctttgtcttattctttacctcagaatatcgcacggaaattttattgccagaaattagatgtatctgtaacaggtcaaaacttaggatatattacttcagccaatgtagcaactccggaagtttcaagtgccggttctggatatgccttaccgcgtactttactcttcggtattaatgttacattttaataatttgaaatataagaaatatgaaaacaataaaatcaataattatatcaggtatgttactggtaatatctggtggcataatgacttcatgcagtgatttattggatttatctccaattgatttttacggaagtggttcttattggaccactgaagcacaagttaccggttatatggatggtcttcataaacatctgcgtgatgtagccgaacaacacattttcaccttcggagaactaagaggaggaatctataaaagtggcaatgcatctgatggtaacgcactatattatggcagtattatattgcagaattttgataagaacaatacaggtgtaaccggttttggaggtcattatggacgtttggctaatattaatttatttattgaccgtgtgacgaaagcagattatgtagatgatgccaagaagaaattttatttaggacaggcatatggtttacgtgcttttatctattttgaactttatcgtatttatggcggtgtacctttgagattggatgtagaagtaattgatggagtgcttgatcccaataaattatatatggctcgtgcaacacctaaagaagtaatgacgcaaatcaagaaagatttggatctttcaatggagtattttggcaatgtaacagcttttgatccatataatcgcggtaaaaaagtatattggtccaaagcagctactgagtgtttgatgggagaagtttatctatggacttccaaggttactacaggtgacaacgaggctaatattgctgatttggcagtagcaaaacaacatttacagagtgtcattgataattacggtctgagtatgatggataatttttcagatgttttcgaagctaaatcccataaaggcaacaatgaaataatatttgcgattcgttatcttgaaggagaagcgaccaatagaaatgtcaactatacatacatgagtcagggagagatagataaaggaggttttcgtgaagatgggactccatggaacgatcctttaggattaaagaaaagtggtgctcaatggtgtgagtatattcctgaactctttcaattatttgacgtagaagacactcgtcgtgatgcgactttcctggcttcttataaaaaagataaagatggtaatttaagtctttggggaactcatgtccaaaagaatataggttacataaattctgaaggcaatcgtgttttttgtggggattatgcattctatcgtctaccttgggtttatctttcattagccgaaattgctaatatggaaagtgataattctggtgttgagaaatatatcaacctggttcgtaaacgtgcttatgcttccaattgggacgaaaataagcatgggtataaatcaggagatttcactcaaaatgagttggccatattacatgaaaaagataaagaatttgttcaagaagggcaacgttggtgggatgtgttacgcatgactctgacaaaaggtggtaagcatttagtattctgtaaagaagctaatttgaaaaataatggagtgccaatcttaaatgaagcgacagagagtcacaaagttctttggcctattgaacagaatatgcttgataaagatccgtcaataaagcaaactccagggtatgaagaataacacaatatctgcatacttaatatgttagttatatcaaatgtgatttctattaatatttgatactcttttcttagtaatagtatgtttttgcatgctattactaagaatcttttttattagtttgtataaatgaatcttttttgctaacattgtgagtgagtgtaaaataacttatttaatataattatataatatgaaaaaatattgcttacttctattctggctaatatgtattcccttaatggggcagcctatttataagccgaattgggagtctatagataaaaggccggttcctgcatggtttgaaaatgcgaaatttggcatttttatacattggggattatattctgtaccggcatggtcgcccaaaggaacttattcggaatggtataaatattggcttgataaaagaacattgatgggtaatggaaattttacaggaacagaaatatatgattaccatcggaaaatgtatggagaagatttcacttacgcagattttgcccccatgttcaaagctcttagttatgatcccgaagaatgggctgatttatttgagcgctcaggtgcaaaatatgtagtgctgacaaccaagcatcatgatggatttgccttatggccaagtagagaggcatcaatcagctatggcagaccatggaatagtatggaaataggagcacatcgtgacctggtgggagaatatgtagatgcgttacggaaaacggatatcaaagtcggatgctatttttctttaagagaatgggataatccactttataataaagagacaatggatttgttttatgaacgccattggtttccgcaattacaagatttggtaaatcgttataagccggatctgatatgggctgacggtcctgatcagataaatgacaaacagtggcaagctgaaaggacattagcttggttgtattcagaatctccggtaaaagacagcatcgtggtcaatgatcgctgggccaataacaccggcagaaaacatggtgactattatacacgagaatatagcagcactaacagtacttttgataagccatgggaagagtgccgtggaattggcctctcttttggatataatcagaatgaagatctggaagattacacttcaccgaaagcattaatattaacgcttgcaaacatagttagccaaggtggaaacttactattggatattggtccgaacgctaatggcaaaattcctcctataatgcaggaacgcttgttgcagataggtaaatggctgcagataaacggagaagcgatttatggaacacgcgcttggaaccgttcatgccaatggactaagggtaacagggagtggaaatcaaaagaaaagcattacgtcagtggagatgccatattgaaacagacagtcgatccggagcccggatatgcggtaaaagaagtttttttcacccaaaagggagaaaacgtatacgctattttacctcaatatcctaaaaataaaattgtgttgaaaaacgttcaaacaaggaataagactaagattactttattaggatcagataagaaagtcctttggaagcaaaaaggtaatgatcttgaaatcacaatgccttctctgtacgcagatgaattaccttgtgattatgcatgggttcttaaattgaacaacttagaaaataaagaagatcgataggtatattatataaaatcgattagtttcttttttgttgcgcgagcatgctgcacaaattgaaaaggcagtatctgagtatctttctgtatacttgggtactgccttaaatataaactctatgaagctttttctttaaataattatctctataagtatagctgaatttgttttccttcaagtacccatcagttagtactataaaatgttaatagtggcattgcttttctattgtgttaaaatgtatatattgtaaataattgtcaatattttttctaatggctttctttttccactgtttttgtccgcagtgatgtttatattgcatttttataacatttatctgttgttttataccattggtctaccgcccgaaaaaagttatttttttacttatattagccttttggggcttaaaaaataaattgtatatcactgtatatcagtttgttttctgcttactctctttcttttctctttccatttttcgcctaccgtcccgatagaacttagtaaaagcaattataattatctttattattaactaaaaagcaatacttatgaagaaaaccatcttcttgattttgtgcttattatgctctataggagctatagctcaaacaaaatccatcacaggtgtggttacagatggtaccggtgaatctgtcatcggtgcaagtgtcgttgaggtaggtacaaccaatggtacaatcactaaccttgacggcaagttctcattaacgatagctactggcgctaaattcacagttagctatattggttacaaacctcaaacaattactgttagcgctgcaaacacttacaatgtagtactgaaagaagatacagaggtattagatgaagtggtgattacaggatacggtggctcacaaaaacgtgcaactttaactactgctatttcaaagcttgataattctgtacttaaaaatgcggctttcagtaatgcaggacagtctttacaaggctctgttacaggtcttcgtgttgttaacaaaacggggcaacctggtagtgaaccggatattacattgcgtggaggcgctactattacaggcgacaacagcaaagctcttattgtagtcgatggtattgttcgcaatagcatgagtgatattaatccctctgatattgaatctattcaggttttgaaagatgccgcttcaacagctatttatggtgcacgtgccaatggtggtgttattttggttgagactaaaagtggaaaagaaggaaaagcatctgttaattacaaatttaaaatgggtgtgaacttcgctcgtaaaggctatgatttttgcgatgcacacgattatatttattataaccgtatgggctacaaaagaaccggacgtaccaatgtcgatacacaaatgggatatggtattggtaataacttatttgatatccgctatttgacagacgaaaatgctaatctgaaaaatgaaggttggtcttctatggcagatccattttatgatggaaaaacaatcttgtataaagactactctggtgaattggacgatgtggtgtttaacaatagtgctttaactcaagatcattatgtgaacattacaggtggtaatgataaagggactttttctgcaagtttaggctactataaagaagatggtcagattagaggtactggttacgagcgcttcaatggtgcattgaatggttcttataaagtatttcctttcctgacagtaaaggctaatgcgacttactcttggtcaactcaaccggaactttggatcggtcaatatgaatttttctaccgtacacgttctcaacgtccgacatggaacccttggaatgaagatggaactccggcctccggtttcggtacaggagacggtaatcccgattattacagagataagttgacgagcgagaacagcactaataaatcaacctacagtgttggatttgcccttgacattttacctaaaaaattagtgttaaatggaaatgcttcactttatcgttatgactggcagagagagaagtttaataaatcttatcaagctcaatcttctgcaactcctgataatacacgtcaggctgaggcttatgttcagaaatacaatcaaattcagttgaacggaacactgacatacacagatacttttgctgaaaaacacaatctggaagcaatggtaggaactgaatacttcacctatgatcagttcgattttgaggccaaaacccaaaactctccaactgacgatattcctaccttgaatgctggttctacaaggacttatacttctacaactaaaacagcataccgtattctatcagggtttggccgtatcaattataactatgacatgagatatttaatttcatttgttgctcgttatgatggtatttcaaaactgaaagataaccgttggggatttttccctggtgtatctgtgggttggaatatcatggaagagaatttctggaaggattctaaagtctcagaagttatttctaacttgaaacctcgtcttagctatggtgtaaatggaaatgtaaatggtatcggaaatttcgatgtatatggtgcttactctcaagtaggtgcaaagacatacggaggttcaaccgcattctacaactcaggcttggtaaacaccggattacgctgggaacaaagtcagtcatttgaagctggtctggacatcggattcttaaacaatcggttaagtttcattcttgactactacaaccgtactactaaagacttgttaactaaacaagcacttccgggatatacaggctttacagagatcatgactaatatgggaactctgcgtaactatggtttcgaaatggaagtaagagccaacattctgaataacccgaaaggattgacatgggatgttacagccaatctgtcttctgtagcaaacaaaattgtgaaattaccttataacggcaatgaaaataaccgtgtaggtggctatgaagtggcaaccggacgcaaaaaagccgatggaactcctgaaacaaaatggattgccggccgtcaggaaggtggtaaactgggagaattggttgcttacaaacaaaatcatatattcaaagattgggatgacgtgaaaaagtatgccaataaccgcatcgacgaggtagccaacttatatggtcccggacttgcagcccaatatgccggaaaagaaggatggcaaccgatcgaaccgggtgatgtttgttgggaagatatcaatggcgatggtgtaatcaatggatatgaccgtcaagtagtaggaaatatatttcccaaaattactggtggattctctactacattgggttataaaaacctctctttatatgctcgtttcgattacgctttaggacataccatttataatgatctcgcagcacgttctttgggacagtatcaaggttcattcaatattattaaagaagtaaaaaagacatggagtgagaccaatactgatacagatttacctgcattctattacgcagaccagttaagcaagaaaaatattacacgttcaaataacggtaatacagctattgataataacagttcacgcttctatgaaaagggtgattatctggctttgcgtgaattgacattaaattataatctgcctaaagcatggatcagtaaagttggtatgacagatgcatcagtctatgtaacaggacagaacttattctatatcaccggatacacgggtgtttctcctgaaccggctgtagatacaacttatggtcgtggaatagataacggacgttatccaactccgagaacagttttattcggtttgtcagtgacattctaaattatatatgattaatacaaatagcattatgaagaaaatatttacatatatgttagcagggctttctctcctgctgttttcaagatgtgatgcactggatattgaacctaccagttctattgcggatagtaattactggaagactgaagctcagttcagtacctttaatgtaggtttgcatgcattacttagagaatgtagttttaattttttcttattaggtgagcctcgtgcggacatttatggagacgttccctttggaggagaagccactcaaggtatggaacgcttgcctttcaatacgataaataaggagaacacaggaataaccaactttgcaggaatgtacaaagtgatcaatcagatcaatttgatgatcgctaaaaccaaagaaacgactgtacttcccgaagctactaaaaactattatttaggtgaagcttatggtatgcgggcatatctttattttcatttattgcgttcttggggagatgttattctctatctggattatacgaatggagcctctttagacttaagcaacctctcaaaagcagcctctcctgcagaagatgtgatgaaacaaatcaaagaagatatcattgcttctgaaaaggcattcggcagtgattactctttcaaattcggcagatattactggtcaatggccgcaacacaaatgttgaaaggtgaagtttatttatggagtgggcgtcaaatgggtggcggcacaacagattatactacagccaaaacagctttacaatcaattatcagtaatgtaaatgtcagcttgcaggatgatttctcaaaagtatttgcttacaataataaagataatgccgaaattattttctctatacgtaatgcaaaagatgagtataacatgtgggacgatagatttagacaaaacttagtaccacagcaggcatacatgactgcaacttactgtaataaagaaggaatttcatttaaagatttgcctgaaggacaacttaacggtttgattcgtctgcagataagatacgatttgtataataaggcattccgtgatggagatacccgtaaggacgcttccatgacagctgtttaccaaaagcaagaagatggcacaattaaatatattgctcctttctgcaataagtatcagggagtcctgttggacggagcttcacagcgcagttttttgaatgattaccccatttatcgatatgcagactgcctgttattacttgccgaagcaaaagcgctgttgggagaagatccggcaactgagatcaatcaagttcgtgaacgtgcttatggaaaagagttctttgagttaaacaaagctacgctatcttatccgaatgataaaggagacttctatacggataataaatacatgtccggtgatgaagatcctttggaagccattttgaaagagcgcatgcgtgaatttatgtttgaagggaaacgctggtatgatttaagattattgggtgcagactatgtgacaaagcgcacttctgccgttgccacccgcctattatggccgattaatgaaagtgtattgacagacaatccggcgttaaaacagactccgggatatgaaaattgattagttagtataagcggggaatgtccgaccggacattccccgctttattttgttctcctccatctgcatatataaaaatcggctctatgattggagaataaggagtaatgtgtgtatggcaatgaaaaaagagaagctgtctcaataataaccgagacagcttctacatttaataaataatcatatttaaaacctattgattaagttttatttttcatatccaggtgtctgtttcagcaatggattgacactcataatgttaacatcaataggccataacaacttgtattcctcgcttgggtccaaaagaggtttatccgaaggataattcgcagtagcagagaaagcaagagatttgccattagcatcatgcatacgtactacatcaaaccatcgcttaccttcccaaacaaactctttatcacgttcctggagaatggtcaattcattctctgcataatttccttccgtatatttattagcctcataattggagccatatgcacgttcacgcacttcattaatataacctgcgcaaggatttcctaaaccattttctatttcagccatcatcaataaagcatcggcataacggtaaacaatcacatcggtatcataaatacgattgttgttcgagttgatagaaccaatagccttaagcataacacaaccaaagccttctttattcttttgggtataatattctaagaatgttgcatcacgacgagtgtctttatcgctatagcttttccagaaatcttctgtatattcatggcggaatgtacctccggtacctttcaaatttaatgtatccgtttcaattttattatcatcacggtcatatacctgtccaatgaatactgcctcctgatagaggaacatgcctccccagtttgtagcttcgccatcagcaaaatgtaaggtgaaaataacctctgcattattacggttagctgtactaaatacatcgctgaatttatttaatagctgaaatttgcctatcactccattcagagctgttttggctgtttctaaatccgatcttccagaagctgtatagccatttattgaaactttagcagcccacatataaatttccgctttcaacatcagagtagcagctttagaccacattgtcttatcatatttattggtcacttcttctgtaccaaaatagttttcagatttaccgatatcttcttttatgaaggccatagtggcctcgggtgtagcacgttcgacataaaatttatctgcagtcactttgccatccagcaactcgactgttgttacaataggtactccgccgtaagttttataaagcataaaataataaagagcccttaaaccatatgcttgtcctaaataggcttttctgtctgcctcacttaaaaaatcacattcattctcaactttttgaatgaaatgattaacttgcataatcggactatataatccaaaccagttgctgaatcccggattatcctggcttaaagtgttggtacgcaatatggcatagtccaaactggtgttttgtgaagaactaccaacgcgctgtgtaccaccgcgcaattctcccaaacaataaaacatattatagttacctctcaattgagagtgcatgccattcataaacccttccacctgggctttattattccagtagttgccgcttccgaaatagtcttccggagcgagatccaatgcatcgcatgaagtgtaaagcacagacgatacaaataaggaaatgatatatattatctttttcataatttgtcttttttatatttagaaagaaacattaataccaaaaatcactgtacgaggtaatggatatcctccattattatctgctttttccggtgagaataggtgttttgcttctgtcaaatagcctaagttctgacctgtaatagatagttccacattgctcaacttagctttttgcgcccatacagatggtaatttataggataatgagagttcacgcagcgccagataatttccattataggcaaacatggatgagctacggcaataattacgtttacccaattgatcggcccatacataagttggatatttagcattcggattttcaggagtccatgtgtttttggtctcctcaatggtattataagtaccttgagcacatgccatgatccacattgttttccagtccactgcggtgaatcccaatgcatagtcgaaacgtgcagacaaggtaaggtccttccagcttacagtagtattgatacctcctgtccatttaggaacagtattcccaattttcaccatgtcataattatcaataactccatcgccatttacatctttccatttcacgtcacccggctgaatcggaagggcattggctttttgagaatctgttaatttattgtaaccttctgttccaccataaagaggacggccacttgaaccgttattacctgttgtcaagtcaatcaagttagccgggatttcgtcttgagatttataaagtccttctgccacaaacatgtatagatcgcccggacgttgtccttcctgatatccaccaacccacattttttcatctccgtttccagtataaacctgataagcactttgacgatttctttcaagtccattgtccggcaaagaaacaaccttgtttttgttcaaagcaccattccagttcaagttccacttccagtctttggaatcaatgatccggaatcctaattcaaattcaaatccttgattctggaactcaccattgtttgaagtaacagaacttacacctgaagtagacggtactgtgatattagcatatttatcactagtcaaacggttgtaatatgtcaagttagcattgatgcgattttccaaaaagcccatatctaaaccgacttcaaaagttctcgatttttcccacatcaaatatgggttaggaatgctgcttaacaagaaaccggttgaaccattatagcgattgctgccataagctccctgaactgtatagtttccaacaaagttcttgtttacattaccatttaaaccaaagctggcacgtaatttaccgaatgaaagaatagatgctgtgttttccataaattcttctttactgaacacccatcccgctgatacacccggaaatactccccaacggttttctttagctaatttggaatatccatcccgtcttaaaaccaaagaaagcagatacttagattggtagtcatagttaacacgtccaaagaatgacataatacgttgacgagaatgtgaagagtctatagaacgcattccttcctcttttgaggtgtattccaaatccataaaatcatcggtgggagctccagaaccagaagcactgaatcccttgccgtatgaatcatagtattcaaaaccaaccattgcatccaagaagttgtccttattgatctgataattatagttcaatacggcattatatgtttggtctaaagtacggctatatgaagcagaggtggcgtgagatgtaatcaagttacccggagagctcaaatagtctttattaaaagcttctgttttttcttcggaataataccagatggctcctaatttcaatgagagacctttcatgaaatcaattgtgaaagattgattcatcgtaaacttatccgtattattatcacgaacgaattgcttaaaattgtattgttggttaccatcaccggagttcggtcctaatagcatatctccatctgcattataaccacggaaagtaggaggtaatgaaagacagcgtgagaaatagttagcctcagctgtttgcgatgcaggaagtccgttccaggtcgcatctgcaaaattgaaacttgaattagaagttaaccattccttaagtttataatcagcattaaaagtaaaagtaattctttgataccagttacctactgctgtaccctcactcttattgtagcccaagccggcataataacttcctttatcattaccaccgcttacgcttaagttataatcctgagagaatgaaggtgtgtttatattaaaatcggcaatgtctgtgtttttataaataattttatctccatataccgggtcaatcatagtctgccatccttgattgagcagaaaagatagattgtctgaatagatcatcggactccaaatagcagaacttgttttatttccgtctaatggcgttacaccatccttgtcaaaatataaattacctgttccataaggagttgcagtagtcaatccgcttagagaagaccatcctttcacattagcaccgtccgggtgtttcatgtctccaacgtacgcattcatataagcagtacgcatccagtaaaggtaatcaccggcattcataaagttataagaatccttaaagtagttcaagccaaactttgcttttagatttacctctgctctacccgccttaccacgttttgttgttacaagtactacaccatcattagcacgtgcaccgtaaatagcagttgcaccggcatctttcaacacctccattgattcaatatcatccggattaatatcactcagcgaagagcgtacctgaccgtcaattaagatcagtggagaaccagaaccatcaaagttcgtaccaccacggagtactaaagttggagcactacccggattacccgaagtctgacttactgacaaacctgctacagcaccagaaagagcttgagccggattagtaaacataccttgttttaaagtttcctcttttactttggcaatggagttagtcactttagaacgcaattgtttaccgccataacctgttacgaccacttcatccagcatttcagagtcttctttcaacttaatattaaaagaatttttgccctttacatcgatcgtttgaggctgataaccaacataagagactttgatctttccattgggatcgaccattaatgtaaacttgccgtcaatatcggtaattacaccattggtggtaccgacttcgacaacacttgctccgatgattgattcaccgctagcatccataaccacacctgtgattgatttcttttgcgccatggctccgatggaacataacaggcacaaaatcaagaagatggttttcttcataagtattgctttttgagttaataataaagatgtttatatgtgtttttaaaactgtttactaagttctatcggtacttggtatttttactacctaaataataaatgaaaaaggttaaatttattatttcttttcatttatatactatcaaaccgttgcaaatatatatattatattaaaaactcacaagtatattttaaatatattttttatataaccgaaataatattgaaaaactaagataatcagctccggattctcataaaagattgtttatggaagagtgctatatatataatattgatttcttatattatatatgagactgctttcattaaaatggacaaatgtaatatgtttttattttgaaatactgtttgattaacttgaaaagtgccaaagattatatctaataaccttattatatgttataagatgtttctttgtgttgaaagatggatcacttcatttcacttacataaaagtggcttccgaacacaagaaaagatgaaaagtatagtctgatgattcactacttttcaccataataaatttgtttgtgaacatttgtacgaaaatatttttttaaaatctttcgtttgtaatctaaacaattgatgtttagattattgcatatttattgtccttatttctgttataccatataaccaagtaccgataggactgtgctcattttcaggtgtttatatttaagagatttagaagagataattttccttttttattaactaaaaatcaatttatgaaaaaagtcctttttattttgttgggctgtttgctatcgtttaatgtgatggcacaggtaaaggcgatttcgggggtggtaacagatgttaccggagatcccgttattggggcaagtgttgtagaagtgggaaccactaatggagtaattactgacttaaatggtaagttctcgttaaaagtggcgcctaattcacaattcttggtgagttatattggctataaacaacaaactattaaagttggttctgaaagcacttataatattgtgctgaaagaagattcggaagttctggatgaggttgttgtagtaggttatggttcacaaaagaaggtgaacgttacgggagctgtaggtatggttagtgctgatgcattggaagcacggccggtagcaaatgcttcacaagcgttacagggggttgttcccggtttgaatcttactgttggcaataacggtggttctctggatggaacattgaacatgaatattcgtggagccggaacgatcggtgatggatcgggttcttctccattggttttgattgatggcattgagggtgatctgaatactgtcaatcctaacgatatcgaatctgtttcggtattaaaagatgctgcatcggcttctatctatggtgcaagagcttcgttcggtgtgattcttgtaactacaaagagtggtaagagcggtaagacaaatgtgtcatatagcggtagcgcacgtttttctgatgctattggcattccggacattatggattcttacacttttgctcagtacttcaatcgtgcttctgccaataaaggtggcggtgatatttttgcacctgccgtaatggagcgtatcaaagcctatcaagaaggaacgctgaaagctactacagttgataatggagcaggtatttggcaaaaatgggctaatgcgaatggaaacacggattggtttgaagaattttatgatcattgggcaccatctcaggaacataaccttagtattaatggtggtacggacaaaacccaatacttgattagtggaagttttctggatcagaaaggtttaatgcgtcatggatcagataagtttcaacgttacacactgaatggtaaaatcacaacggctgtcactgattggttcaaggtgacgtattctactaaatggacccgtgaggattttgaacgtcctacttacttgacaggaaactttttccataacttagctcgtaaatggcctgtgcatccggcttatgatcctaacggattccctatggacgaaggtgaagtggaacagatggaaaatggaggaaagcagaatagccagaaagatttttatacgaatcagttgcaactggttttcgagcctattaaaaactggaaaatcaatcttgaaggtagtgtacgtaccactactcaatatcagcattgggaagtattacctgtttatgcctacaatgtagatggagatccctattatacagtgtgggatatgggatatggttcttatgcggcaggttcttctcgcgtgaatgaatatagttggaaggaaaattattataccacaaatatttattcggactatttcaaacagttcgataacggacattattttaaagtgatggctggttttaatgcagagttatataaaaccagaaacattacggctgagaaaaacacattgattactccgggggtaccgactattaatacggcaactgatgacccacaggcttatggtggttatgccgacaactctgtagccggtttctttgcgcgtgtcaactggagttataaagatcgctatatgtttgaggctaatggccgatatgatggttcttcccgctttgtcggaaaagaacgttggggattcttcccttcgttttctgccggttggaatatcgcccgcgaaccatttatggaaagctttgctgaaaagatcaatatgggaagtttaaagttaagagcttcatggggacagttgggtaatacgaataccaatgatgcttggtatccattttatcagactatgcctgtagggtctaattatggttggttagtaaatggcgaacgtcctaactatgctacaaatccgggcattgtcagctctaagaaaacatgggaaacagtagagacttgggatgtcggtttggattggtctttctttaataatcgtttgtctggttcattcgactatttcgtacgttatacttatgatatgattggtccggctcctgaactttcaagtctgttgggaacttcagttcctaaaatcaacaactcggatatgaaatcatatggttttgagttggagttgaattggagagaccggattggtgaagtttcttatggagctaagttagtgctttctgatgaccaacagaaaattttgcgttatccgaatgactcatatgatgtaggttcgtactataaaggcagacacttgaatgatatttggggattgacaacaattggcattgcaaaaacacaggaagagatggatgcccatttggcaaaagttgatcagtcttctttaggaaccaattggggagccggtgacatcatgtatgccgatttggatggtgacggaaaaataagtaatggtactaataagttaggagataccggtgactatcgcattattggtaattcgacccctcgttttaaatatggtattacgttggatgctgcgtggaagggattcgatttcagcattttcatgcagggaatcggaaaacgtgacctgtggttggacggatgttatttctggggggctaacggacaaggaaatgagtggcaatctaccggttttaccgaacattgggatttcttccgtccggagggtgatccgttgggtgcaaatttaaatgcatattatccacgtgtcaactttagtggtggtcgtaacactcaggttcagactcgctatttgcagaatggtgcatatctgcgcttgaaaaatgttcagttgggttatacattgcctcgagtatggacagagaaagccggaatatcttctgtacgtgtatatctttcaggagataacttggcgacaatcaccagcctttctaaaattttcgatccggaggctaccggaagtttggctggaacaggatccggtaaattgtatcctttgcaaagagtaatatctgtgggtgttaacattaatttttaaattgaagcattatgaaacttaagataaaagatctgtttatacaagcatgttttattgcaggaggggcattggcatttacatcctgtaatgactttcttgacagagaaccgctttcttctgtcacaccggaagtatattttcagacagtagaccatttcgctgcttattctatagcgaagtatcaaaactattttccttcccatagcggttatggagcagggatagccaataatgatggcgggacagataatatggtggccggagggcgtagtagccgctatgtgaaggggctttggaaggttccttcgagtgatggtaactggagttttagtaatatccgttattgtaattacttttttgaaaatgctgtgcctaaatacgaagcgggtgaagttgccggagcggacgctgatattcgtcattatattggagaaatgcatttgatgcgtgcgcttgtgtattataatctgttgcgtaattatggtgattttccgatcataacggaagttcttcctgacgataaagcggtactgatggagaaaggtgttcgtcagcctcgtaatttggttgcccgttttatcttgaaagatttggatgacgctgccagtatgatgtatagtcagggatttaagaataatactcgtttgaatcgtgagacggctttgttgattaaatcacgggtagcattgtatgaagcttctttcgaaagataccataaaggtacaggaagggtaccgggagatgacaactggccgggaaagaaagtgcatcctaatttttcgttggatgtggaagcagaagttgatttcttcttgacagaggctatgaaggctgcggaagaagtggcagataaaatcactttgacacccaacacgaaagttgcggacccggctaatccttctattacatccggatggaatccttattttgagatgtatgctactgttgatttgagtggctatgatgaagtgcttttctggcgccaatatgcaaaaaccggtagcttctctatcatgcatggtgctccggcatggattgcatctggttctaatcatggtttgttgaaaagctatgttgaaagtttcttgatgcaggatggtttaccttggtatgcggcaagcagtgcggctccttataaaggtgatgctacattggataatgtgaaagcaaatcgtgataaccgtcttcagttgtttatgtttggtgaaagtaattttgtgcctgtatattcaaccgaagaagcgggtacggtgaaaatgtttgctccacacccggtgtctaaccgtgaagagatgagagaccagacaggatatcgcattcgtaaatatgccagctttgatatggcacagaatgtttggggaaaggctgaatcaactacaggatgtattatttaccgtggtgttgaggcttatctaaattatctggaagcttattatatgaagaatggcaatgtggcaggcaaagcggctcagtattggagagctattcgtgagcgtgccggattggatcctgattttacaaaaactatcaatgcgactgatttgaatcaggaaacagattggggtaagtattcaggtgcccaggttgtagatgctaccttattaaatatacgtcgtgagcgtcgttgtgaatttattggtgaaggtatgcgttgggatgatttggttcgttggcgttcgatggatcacttgctgacgaaaaactatatgcctgaaggatgtaatttctgggatgaaatgtataagtcggctaacaaagatgagaatggtgctgagattacatttaaagattctggtgaagaaggttccaatatctcttcacgtacctttaagtatttgcgtccttatgccattttgaaagccaataatgacgtatacgacggttatacctggcagaaagcccattatctcaatcctgtgccggttcgcgagatggaattgctatctccggatgaaaaagtagaaacgtctgtattataccagaatccttattggccaactaagattggagaggttgctgaagaataattcggttttcaatagattattaaaataaagtagaggagaggggtgttattgaagataacgtctctctcttttttattctgacttcagatatgctcatcacaaagttaaaactcagaatccgaaagattcagagtaaagtatattttgatctttagagaaatgttttcttcgtacaagccaagttcatcttggcagccaggatgaagtttaattaccattttagataagtttgttttcggtcctttagcactttgaaagagggatttgtcgttttataattgatctcttagtctctttctatccttttgggagtgtctgtgttctgtgaaaaaacagacgaaggaaatttagacaggcttttatggcaaatagaattaaaaacaatccctgaacttgtgtgtcgtttattaataggttggtatataataaaatatttaattaatatagccattgtataataaaaaatactatctttgctcccgataacataaatattaattagtcgataccatgaaaaaagctgtaattctattttcgcttttctgttttctgtgtgctataccggtagttcgagccgcagatacaatttttgttcgtgagacccgtattcctattttgatagagagacaagataatgtcttgttctatcttcgtttggatgctaaagagagccagactcttaatgatgtagtgttgaattttggtaaaggagtggatctgtctgaaattcagtctataaaactttattatggtggtacagaagcattgcaggacagagataagaaacgttttgctcctgtgggatatatctccagtaatacaccgggaaaaacgcttgccgccaatccttcttactcaataaaaaaatcggaggtgagtaatcctggtaatcaagttgttttgaaagggaaccaaaaactgtttccgggaatcaactatttctggattagcctgcaaatgaagccgggtacatcccttaccagtaaggtgactgccgatattgcttcggtcactctggatggtaagaaggctctgttggatgttgtttcgcaagaaggaattgaacaccgcatgggggtaggagtacgtcatgccggagatgataattctgccgcattccgtatcccgggattggtgactactaataaaggtacactgctgggagtttatgatgtacggtataatagtagcgtggacttgcaagagcatgttgatgttggtttaagccgtagtacagatggtggaaaaacctgggagaaaatgcgtttgcctttggcatttggggagttcggtggtctgcctgccggtcagaatggagtaggagacccttctatccttgttgatacaaaaacaaataatgtttgggtggttgctgcctggacacatggtatgggtaaccaacgtgcatggtggagttcacatccgggtatggatatgaatcatactgcgcaacttgttcttgccaaaagtacggatgacggtaaaacgtggtctgcacctattaatatcacagaacaggtaaaagatccatcttggtattttctgttgcaaggtccgggtcggggcatcactatgagtgacggtactttggtattccctactcagtttattgattcgacacgtgtacccaatgcaggtatcatgtatagcaaagatggtggtaaaaactggaaaatgcacaattatgcacgcacgaatactacagaggctcaggttgccgaggtcgagcccggagtattgatgttgaatatgcgtgataatcgtggtggaagtcgtgctgtggctattacaaaagacttgggtaaaacatggacagaacatgaatcttctcgcaaggcattgccggaatcggtttgcatggctagtttgataagcgtgaaagccaaagataatgttttgggcaaggatttattgatattctctaatcctaatacgacgaaaggacgttataatactactattaaaatcagtctggatggtggtgtgacttggtcacccgaacaccaacttttattggatgaaggcaataactggggttattcttgtcttactatgattgataaagaaacggttggtattctttatgaaagcagtgtggcacatatgacattccaggcagtgaagttgaaagacattattaaatgagaaatttccccccataaactaaataaacaccgatgagaaataaacaaattttcttaatcagtttcattatttacttatgcacaatttctacggtccgggcaggtgaatatcacctgcttccggagccgcaaaagtttactcctttaagttccagttttgtactgggcagaacaaagctttctactccggtgcttcggcaagagtgggaagcttttgtcattgaaaggggtggagtggttgacgacaaagctcgtgcaagtattgaagtgaaactggtaccttcattagaagaggtacctttgaacgcagacgaagcttatcgcctggtggtaaataatggtaaagttacggttgaggctgtgacggagcatggtgtgtattgggctatgcaaactttggcccagttacaggatgtgcgaaagaaaaaggcaacattcaacggttgttcaattgttgactggcctgctttccgaatacgtggctttatgcaggatgtagggcgtacgtatatgtcgattgaagaattgaaacgtgaaattgctgttctttcacgttttaaaattaatgtctttcattggcacctgactgaaaatcaatcgtggaggctggaaagtaaaatttttccgatgctgaatgacagtgtgaatacgactcgtatgccgggtaaatactatacattggaagaagcgaaagatttagtcgctttttgtaaagcgcataatatacttttaatcccggaatttgatatgccggggcatagtgaggcttttgtccgtacattccgtcatgatatgcagagcccggaaggaatgaaaattcttaaattgctggtagatgaagtttgcgagacttttgatgtaccttatcttcatattggtacggatgaagttcggtttaccaatctaaagttcgttccggaaatggtcgaatatgtccgtgccaaaggaaagaaagtaatttcgtggaatccgggatggcattataaacctggcgaaattgatatgacgcatttgtggagttatcgtggaaaagcccaaaaaggtattcccgcaattgattctaagtttcattatctcaatcattttgatacttttggcgatatcattgcattgtataacagccgtatttataatgttgagcaaggaagtgacgatattgcagggacaattcttgccatctggaatgaccgttacgtagctaacgaacgcaatattatacttgagaataatttctatcctaatatgctggctattgctgaacgtgcatggaaaggcggaggtacagaatattttgataagaatggtactatcttaccttctgaagactctccggagtttaaagaatttgctgattttgagaatcgtatgctttggcataaagagcatacatttaagggatatccgttcgcctatgtaaaacagacgaatgtaaaatggaatattactgatgcatttcctaatggtggagatttgaataaagtctttcctccggaacaggaattgaaggattcttatttatatgaaggaaaagagtatggggtacaccctgccattggtgcgggtatctatcttcgtcatgtatgggggaaaatggtacctactttctataaagatccgcaagagaatcatacggcttatgcctatacatgggtttactctccgaaagatcaggaagtagggctatgggctgaatttcagaattatggtcgttcggaaatggacttggctccgttacaaggtaaatgggactataaaggcagccgtatctggatcaataatgaagaaatacagccgcctgtatggacagctactcatagtacaaagagtaatgaaatagcgttgggaaatgaaaattgtgtggcacgtccgcctatcgccgtacatctgaataaaggctggaataaagttttcctgaaattgccggttggcaaattcaatatgcccgaggtgcggttggtgaagtggatgtttactacagtttttgtaactcctgacggagaaaatgcagtggacggacttatctattcgcccgacaaaacgaagtgatcgagaaaaaataaaaacgaatgaagaaaattttattaatgatgttgttgctcgcctcaatggcgggcaacgcacaggaacgcaaatattctacgttctattatcaacgtgcaactctgtttgaggagctgcctgtgacttcaaaagatatcatttttctgggtaatagtattactaacgggggagaatggagtgaattattgaataataagcatgtcaaaaaccggggaatcagtggtgatatctgtatgggtgtttatgatcggctggatgcgattttaaaaggaaaacccgctaaaatattcttgttgatcggcataaatgatgtaagccggggcacctctgcggatacaattgtgaaccgtattggtatgattactcaaaaaattaaacaagaatctccaaaaacaaagctatatttgcaaagtgtacttccggtaaccgatcattataagatgtttggcggacatacgtcacgttggcaagaggtgaaaaagattaatgaagggctgcttcggctggctgacagagaacacgtgacctatattgatctctattctcattttgttgatgagaagaccggcaagatgaatattgagtatacaaatgatggtttacacttactgggtaaaggctaccttaaatgggtggatattgttaaaccttatataaacaagaaatgaaaaagatactattcttatctctatttttgatgatttgcgcagttttgtccgcacagaagcggataaaagttgcttgcgtggggaatagtattacgtatgggtatactcttccaaatccggcaacggattcttatccttcacagttgcagcaacttttgggcgatacttatgaagttggaaatttcggaaaatcaggggctactttattaaataaaggacaccgcccttacatgcagcaggaagaatttaaaaaagcgcttgcctttgccggtgatattgttgttattcacttgggaatcaatgatacggatcctcgtgactggccgaactatcgtgatcatttcgtgaaagattatctggcattgattgattctttccgtgttgttaatcctaaatgtcatattattattgcccgactgacaccgattgccgatcgtcatcctcgttttgagtcgggtacccgtgattggcatggagaaattcagcaaagtatcgagacaatagctaaatatgccggggttcagttgatagatttccatgcgccgctttatccgtatccgtatcttcttccggatgctgtacatcctaatgtagagggtgccggcattcttgcgaaaacggtatattctgcgattacgggagatttcggtggattacacttatctgaactgtatactgacaatatggtgcttcaacatgggcagcctctgactatccgtggcaaagcaaacgcaggagaaaaagtgactgtagcaatagctaaacagaaacagtctgtgaaaactgcttccaatggtgattgggcgatcactctccagcctttgaaggctggaggcccatatactttgactgtttctgcgggaaagcagaaacaagctttcaataatgtattagccggagaggtatggctttgttccggacaatcgaacatggagttctatcttggttggagtaaaactgctaaaagggatattccgcaagccgccaatgatcagattcgtttgttcgatatgaaggcgcgctggcgtacagatgctgttgaatgggatgagtccgtattggattcattaaatcatctgcaatattataaagataccgaatggacagtttgttcgcccgctactgccggttctttctctgcggtagcttactattttggtaaaatgctgcaggacagtctaaaggtacctgtcggattgatttgtaacgcaatcggcggttcgcctaccgaagcatgggtagaccgtaatacattggaatataaatttccggctatattacgtaactggactcaaaatgactttatccaagactgggtacgcggtcgtgccgctcttaatgtgaaaaaggcggatagcaaacagcaacgtcatccttatgaaccttgttacctgtatgaggccggtatccgtcctttagaacaatatcctattaaaggtattatttggtatcagggtgaatcgaatgcacataatcgtgaggcacacgagaaattgtttaaactattggttgaaagttggcgtaaaaactgggaaaataaagatttgccattttattatgtgcagttgtcaagcatcaatcgtccgtcatggccatggttccgtgatagccagcgcagaatgatgtatgagattcctaatacaggtatggcagtatcgagtgacctgggtgattcgcttgatgtacaccccaagcacaaacagccggttggggagcgtttggcacattgggctttgaatcagacttatggaaagaagaatgtaacgccttcggggccgatgttccgcaatgtagagttccgtgatggtgctgcttacgtgtcatttgattgtgctgaaggtatgcattcatcggatgggaaaccgttacggacattcgaagtggctgaaacagaggatgtttattatccggctacagccgaagttgtaggaaatcaaataaaagtatatagtaaagaagtgaagaatcctcttcgtgtacgttacggctggcagcctttcacccgggccaatctggtcaatggtgatggtttaccggcatctacgttccgtacggactggggaagataaacttgaaaaagagagcagtttatgatgaaaaaattattgtatggacttgtatgttgttgcggtttagcttatgggcaaaacagggacacttcggatgtgttaatgttgaatgacgattggtcattctcacaggtggggacagaaaaatggctaccagctactgtcccgggcactgttcatcaggatttgattcatcataaattgctacccgatcccttctatggtaccaatgaaaagaagattcagtgggtggaaaatgaggattgggaatataaaaccagttttgtcgttacagaagagcagttgaagagagatgccgcccagctttcctttgagggactggatacttatgcggatgtttatttgaatggttctctgattctgaaatcagataatatgtttgtgggctatgtagttcccgtaaaacaagtattacgtaaaggggagaatctgctgcatgtttattttcattctccgataaaacaaacccttccacagtggtcctccaatggatttaattatccggcagataatgatcaccacgaaaaacgtcttagtgtatttaccaggaaagctccttatagttatggatgggattggggaatccgtatggttacaagcggtatctggcgtcctgttactcttcgtttttatgatgttgctactattgcagattttcatgtgaagcagcttagtctgacagatcaggttgcaaaactctctaatgaattggaaattaatagtatttctgagaaagaaaagcctgctgaggtcttgatctcttattcattggaaggaggagaggaagtgatggtaaaggaaaatgtaacattaaaaccgggtttaaatcaagtccaaattccattggatattcagaaccccgtgcgttggatgcccaatgggtgggggaaacctcatttatatgatttctcagtgcaggtggtgtgtgatggcaaaacggtcgccgcacgacagcatcgaatcggccttcgtacgatacgcgtagtgaacgaaaaagacaaagatggagaatctttttattttgaggtgaatggcatcccgatgttcgcaaaaggagcaaactatattcctgatgatgcgttgctccccaatataactaccgaacgttataggactctgtttcaagatatgaaagaggctaatatgaatatggttcgtatatggggtgggggaacttatgaagacgatcgtttctatgatctggcagatgaaaatggtattcttgtctggcaggattttatgtttgcatgtacttcctatccaagtgatcctactttcttgaagcgagtggaagaggaggcggaatataatatcaaacgtctgcgaaaccacgcttcactcgccatgtggtgtgggaataatgaaattctggaaggattaaaatactggggatggcaaaagaattatactccggaagtatatgaaaacatgttccggggatatgataagttattccggggattgctgcctgcaaaggtgaaagaacttgatgaagggcgtttctacaaacatacttctccctatttcgcaaattggggacgtccggagtcctggggcacgggcgatagtcataactggggtgtgtggtatggcaaaaagccttttgagtcattagataccgatttgcctcgtttcatgagcgaattcggttttcagtcgttccctgaaatgaagacgattgctacttttgcgtctccgaaagattatcagattgaatcggaggtaatgaacggacaccagaaaagcagtatcggtaacgatttgatacgaacttatatggagcgtgattatgttgttcctgagaagtttgaagactttgtatatatcggacttgtacttcaggggcatggtatgcgccatggcatggaagcacatcgtcgcaaccggccttattgtatggggacattgtactggcagcttaatgatagttggcctgtcgtttcctggtcaagtatagactattatggcaattggaaggcattgcactatcaggcaaagcgagcttttgcaccactgctggtcaatgcgatacaagaaggtgatagtttgagtgtttatctgatatctgatttgttggagaaacagagtcaacttacacttgaaatgaaagtgattgactttaatggcaagacattagataaggaagttgtcagggcagtcgaggttccggcgaatgtttcttcttgtatctttcgtaaaccgttgagtgagtgggtgacaccggaacagcgtaaaaacagtttcttattacttgctttgaaagataaaaccggtaaaaaaatagctgaagaagtttatttctttaataaaactaaggatctggagttgccccgaacaaatgtttctatgaaagtaaagcaatccgatggcaagtgtgaagtgaccttatcgtcttctaagctggctaaagatgtatttatccagattcctgttcagggcgcccgtttcagtgataatttctttgatctgttgccgggggaaaacaagaagataacgattacgtctccggatattaagaaaggagaacagcaaaatattacagtgaaacatgtacgagatacctataactaacacctattaaataatttgtatgagaaatctttttaaaattgccggtttactggcgctcacgggatttatttcttcgtgtaacgacaaagagactacagctaattaccaggtaattcctttacctcaggaaattactactgctcaaagccaaccatttacattgaatggtagtgtgaaaatcatctatccggaaggaaatgagaagatgcaacgtaatgcccaatttctggcgaattatctgaagaaagctacaggtaaggattatgcagttgaagctggaactgaaggtaaaggtgctattctgcttaaattgggtatggaatcagagaaccctgaagcttatcagttgagtgtgaatgcagatggtgtaaccattgctgctcccactgaagccggtgtattctatggtatccagacgttacgcaagtctattccggttgccattggtacaactccttcattgccggctgtagaaatcaacgactatcctcgtttcagctatcgtggtgcccattttgatgtgggacgtcatttcttcacagtagatgaagtaaagacatatatcgatatgatggctttgcataacatgaaccgtttgcattggcatttgacagaggaccagggttggagacttgagattaagaaatatcctaagttgacagaaatcggttcaaagagatcggaaactgtaatcggacgtaattcaggagaatatgatggaaaaccttatggtggtttctatactcaggaagaagcaaaagaaatcgtagcttatgctgccgatcgttatatcactgttattccggaaattgaccttccgggacatatgcagggagcattggctgcttatccccatttgggatgtaccggtggtccgtatgaagtttggaagatatggggagtatccgatcaggtattgtgtgcaggtaacgacagcgtactgacctttatcgatgatgtactgacagaagttatggatatcttcccatctgaatatattcatgttggtggtgatgaatgtccgaagagtgaatgggcgaaatgtccgaagtgtcaggctcgtatcaaagctttgggaatcaagagtgatgctaagcattcaaaagaagagtatttgcagagttttgttatcaaccatgcagaaaaattcctgaacgagcacggacgtcagattatcggctgggatgaaattttggaaggtggactcgctccgaatgcaaccgtgatgtcatggcgtggtgaaggtggcggtatcgaggctgccaagcagaaacatgatgttatcatgactccgaacacttatctatactttgactactatcagaccaaagatactgagaatgaacctttggctattggtggttatttacctttggagagagtgtatagttatgagccaatgccctcttcattgactccggaagagcaaaaatatattattggtgtacaagctaatctttggacggaatacattcctactttctctcaggctcagtatatggtgttgccgcgttgggctgctttagcagaggtgcaatggtctaatcctgaaaagaagaattatgaaaacttcctgacccgtttgccacaattgattaatatatatgaagctgaaggatataattatgccaaacatgtatttgatgtgaaatccgagtttgttgctaattcggctacaggagcagtagatgtagtgatgactactattgacggtgctcccatccattatacattagatggaactgagcctacggcagcttctcccgtatgtgacagtattcttacgattaaggaaagttgtactttaaaggcggttgctgttcgtcctaccggaaacagcaaaatgctgactgaaaagattgctttcagtaaatctacttcaaagcctattaaagctaatcagcctgtaaacaagcaatatgaatttggtggtgtttctacattagtagacggactgaaaggaaatggtaactacaaaaccggccgttggatcgcattctataagaatgatatggatgtaacaattgacttgcagcaacctaccgaaatttcaagtgtagctatcactacttgtgttgaaaagggggactgggtattcgatgcacgttctttctcaattgaggtttcagatgatgataagacttttactaaagttgcttctgaagcatatcccgagatgaaagagacagatcgtaacggtctttacgagcatcaattaactttcgatccggtaaaaacccgttatgtgaaagtggttgctacatcggaacactccattccggcatggcatggtggtaaaggtaacccgggtttcttatttgtagatgaaattacgttgaattgaaaaaatagaaatgacagaaactaaaacgattcgttttctttctatcattggatgtttacttgccgggatggctgcttcgtgcagctcccggcaagttgcgcctaatgaagaagggattagcgtgcagaaaatgaccggattccccgaaggagaacccggtttttctttgggtgtatcggcatgttatgccggcatctatcagggagagttattgattgccggcggatgtaattttccggaaacgccggcagccgaaggaggaaagaagaaattctaccaaggtatttatgccgctgacgcttctgcagactcagttttcatatggagaaaagtcggtcagctgcctgttgctgctgcttatggagtttcggtttcgactcctcaaggggtagtttgtgtgggtggatcgaacgaaaatggatccttatctgctgtttaccgcctttctttgactgacgataaacagactgtgattgtagatacactaccttctttaccttgtacaatggataatatgagcggttcagtagtggattatacacttttcgtagccggaggcaatgtggatggtaaaccttcgaatgcactttattgcctcagtctgagtagcccggagaccggatggcagaggcttcccgattttccgggttctccccgtgtacaaccggtatgtgtaggacaacgtaaagagggggaaacccttctatatttatggggaggttttaccggtgcatccgatggacggtctgcaagcctttctactgacggatattgctattctccatctttgcaacaatggcagtcggtatctgttccggttggcaatgattctgtgcctgtcgctttgggtggtggagccggtatagcactgacggacagtttgatactttgtaccggtggagtcaacaaagatattttcttttctgctcttcagcgcgaggaaatgatgaagacagccgtggccaatggcaagcaaactgttgtagacagtctgaagttggaagcaaaaaagtatatgttgcatccggcaggatggtatcgttttaatgaccggattttgatttataatacacgtcgggataagtgggaagaggctgttcggggtgaagatgttgcccgtgccggtgctgcattgacagggcagggacagaccttctttaatatcaatggtgagctgaagccgggaatccgtaccccggaaatagttaagataatgattgactgattgcagataatctgacattttacttatatttgtacattgaaaacaaaaaactaaaaccaatcatatcatgataaaacctacaatgaaaatttgtactttcttgcttgcggccggtttgatgatagcaacagctggtgtgaaagcgcagtctgtcattcctattcctctccggatggagcaaggtagcggtacttttctatttaccggtgacactaagctgtataccaacctgaaaggtgaagagaagaaaatgttgatggattatctggagacattacctatccatttcaaaaacggtaaaaagcaaacgaaagataacgtggtctctcttatgataacgaaggctaatcctcagttatcttctcccgagagctatacactggaggtaactccgcataaaataacagtgcaggctacttccggtgccggattattctatggcgttcagactcttttgcaaatggctcaacctgcaatggagggtgcctggtcagttcaggctacaacgattcaggattcgccacgtttcgaataccgtgggctgatgcttgacgtttcccgccattttcgttctaaagagtttgtgaaaaagcagatagatgcattggcttattataaacttaatcgcctgcatttgcatcttaccgatgctgccggttggcgtatcgagattaagaaatatcctttattgacggaacttgctgcttggcgtccggaagccaactggaaaagatggtggaatgaaggtgggcggaaatattgtcgttttgatgctcccggtgcttccggaggttattatacgcaggatgatattcgtgaattggtcaattatgcccgtgaacgtcatattactattattcctgagatagagatgcctgcccattcggaagaggttctgactgcctatccggaactgtcttgttcaggagagccttataagaatgccgatttttgtgtcggaaacgagaaaacctttacttttcttgaagatgtgttgacggaagttatggagcttttcccttcccaatacattcatgttggaggtgatgaggccggaaaagctgcttggaaaacctgccctaaatgccaaaaacgcatgaaggatgagcaactggataatgtagatgagttacagagttatctgattcatcgtgtggaggtattcctcaatgcccatggccgcaagttactgggatgggatgaaattctgcaaggtggattggcacctaatgccactgtaatgtcatggcgtggtgaacaaggtggtatcgatgccgtaaaatccggtcatcaggcgattatgactcccggttcgcactgttatatagatagttatcaggatgctccttattctcagcccgaagccatcggaggatatctgccattggaaaaagtatactcttacaatccgattcccgcttcgcttacacccgatgaagcaaaattgatttatggtgttcaagccaatctttgggcagaatatattcagactgacgagcattgtgaatacatgatttatcctcgtattcttgcgctggcagaggtcgcgtggtctgcacctgaacggaaatcatggactgattttcgtccccgtgctttaaaggctgtaggatatttacaatccaaaggatatcatccgttcgatttgaaaaaggagatcggcaatcggccggaagcagcgcaaccgattcagcatcttgcattgggcaagaccgtaaaatataatgctccctacaattcgtcttatccggcacaaggtgataaaaccctgactgatggaatccgtgggagttggacctatagcgacggggcatggcagggctttatttcccgtgatcgtttggacataactattgatatgggcaaatcgactgatttacattcgattggtgctgactttatgcaggtagtgggtcctgaagtatttctgcctgtcgaagtgataatttctgtctcggaagatggagaaaacttcactgaattgagccgtcagacgcatgaagtggttaaatcggacgctgtagtatttaagaattatgcatggaacggaaatgccaaaggacgttatgtccgttaccaggctcgtgccggagaggaattcgggggatgggtgtttacagacgaaatcgttgtaaagtaactctttccgcaggtccggtaaaaccgaacgtataaattagataaatatagagtattgaaagaatgaagaaactaccttatttagtatcacttgcagccgtttggctgtccatagcagtagcttctgcgcaagagagtccggtggattatgtgaacccgtttatcggaacaacgaattacggaacaacgaatcccggagccatctgtcctcaaggcatgatgtcggttgtccctttcaatgtgatgggaggaaagtccgttggtaataaaatagataaagacagccaatggtggtctactccttatgaacataccaatgcttattttaccggattttcacacgtcaatctgagtggagtgggatgtccggagttgggctctttactgttgatgcctacaaccggaaagctgaacgtcgattatttacagtacggaagtgcttataaagacgaaaaggccacgcccggttattactcgaatatcctgactaaatacggaatcaagaatgaggtttcggccactttacgtaccggaatcactcgtttcacttttcctaaaggagaaagtaatattttgctgaatcttggcgaagggttgactaatgaaacgggagctaccgtccgttttgtcaatgagcgtgagatagagggaactaaactactgggtactttttgctacaatccgcaagctgtgtttcccatttattttgtaatgcgtatcaataaaatccctcgtgcccgtggctattggaaaaagatgcgtccgatgacagtagaagcccagtgggacaatacgtccggcaagaataaattgtatactgcttataccaaggagatgagtggcgatgacattggtacatggtttactttcgataccgaagaaggcgaaaccatcgaggtaagcatgggagtgtcctttgtcagcatagccaatgcccgtcttaatctggataaggaacaggctggtaaaggatttgatcagattcgtgccgaagcacgttccatgtgggaggacgatctttcgcgtatcctcgttgaaggtggcacgaaagagcagaagacagtattctataccgctatgtatcacttgctgatccatccgaatattttgcaggatgtgaacggacaatatccggctatggaaggcagtgagatccttacaacgaagggaaatcgttataccgtgttttctctttgggatacctatcgtaatgtacatcagctgatgaccctgcttttccctgatcgccaactggatatggttcgcacgatggtcgatatgtataaagaacacggctggctgcccaaatgggaactttacggccgtgaaacgcttactatggagggtgatccgagtattcctgttatcgtagatacctggatgaaaggcttacgtgactttgatgtacaggcagcttatgaagccatgtataagtccgctacgactccgggtaaagataatctgatgcgtcccgatatcgatgattacattgctaaaggatatgtacctttgacagagcagtatgacaattctgtttcgcatgcacttgaatattatattgccgattatgccttgtctcgttttgctcaggctttaggaaagaaagaagatgcaaaattgttctatgaccgttcattgggctataaacattattacagcaaagaatttggtacattgcgtcctattttacccgatggaacattttactctccgttcgacccgatggagggtgccaattttgctcccagtcccggttttcatgaaggcaattcctggaactacactttttatgttccccatgacattgcaggtttaacccgtctgatgggaggtaagaagaagtttgtggataaattgcagaaagtctttgatgaggggctatacgatccggctaatgaaccggatattgcctatccttatttgttcagctacttcaagggagaagagtggcgtactcataaacaggtgaaacggctgcttgctgaatatttcactgaccagcctaatggtattcccggtaatgatgataccggaaccatgtcggcatgggccattttcagtatgataggtctctatcccgattgtccgggaatgcccgactatacactgactacacctactttcgacaaagtgactattcggcttgatccgaagtattacaaagaaaaagaattggttattacggctgttcgtcccggaaatgatgccgatctgatcaaagaggtgaggttgaacggaaagaaacatgcaggctatcgtatcagccatgaggagttggtgcatgccggaacaatggaatttatattaaaataaaaacagatcaatcatgaacaagaaaatcaaaattgcatttgcttcgatgctcgctgtgccactgttggtatgtgcacaggtccgtacggaacaaacctttgaaaaagggtggaagtttacccgtgaagacagtaaggacttcagtaactccacttatgatgatgcaaagtggcaatcggtaacggtaccccatgattgggctatttatggtccattcagtatcaataacgataagcagaatgtggctatttcgcaagatggacaaaaagaggcgatggagcatgccggacgtaccggtgggcttccttttgtaggtgtagggtggtatcgtctcgattttgaggccccttcattcagtaaaggtaagaaggctactttggtttttgatggtgctatgagccatgctcatgtctatatcaacggacaagaggccggttactggccttacggttacaatagtttttatgtggatgccaccccttatttgaagccgggtgaaaagaatacactggctgttcgtcttgaaaacgaaaacgaatcttcacgttggtatcccggtgcgggattgtatcgcaatgtacatctggtagtgaatgaagatgctcatattcctacttggggtactcagttgaccactccggtagtgaaggacgaatttgctaaggtcaatctgaagacaaaactcgatatacctgcaggcaaaacatttgaaggataccgtattgtcaccgaattgaaggataagaatggtaaggttgtggcaactaatgagaagcagggcagtcagttcgacggcaatgtttttgaacaggattttgttgttactgctccggctttgtggactcccgatactcctaacctttacaatgcggtttcgaaagtgtacgaaggcaacactttgaaggatgaatatactaccccgttcggtatccgttccattgagatcattccgaacaaaggctttttcctcaatggaaagaaaaccatgttcaagggtgtctgcaatcatcacgatcttggtccgttgggaggcatcgccaatgaagccggtattcgtcgtcagatccgtatcttgaaggatatggggtgtaacgccatccgcacttcacacaatatgcccgctcctgagttgattaaggcttgtgatgagatgggtatgatgattatggcggaatcattcgatgaatggaaagcggccaaagtgcagaacggttatcataaagtttttgatgaatgggcagaaaaagatctggtgaatctgattcatcagtatcgtaacaatccaagtgtggttatgtggtgtatcggtaatgaagtgccggatcagtggaacggcgatcgtggaccgaagctttcacgtttcctgcaagacatctgccatcgtgaagaccctacacgtcccgttactcagggtatggatgcgcctgatgctgtggttaataacaacatggctgccgtgatggatgtagccggtttcaattaccgccctcacaaatatcaggaaaattacaagaaacttccgcaacagattattttgggtagcgaaactgcttctactgtcagttcacgtggggtttacaagttcccggtggtacgtcgtgccatgcagaaatatgacgaccaccagtcttcatcgtatgatgtagaacactgtggttggtccaatcttcctgaagacgattttatccagcatgaagatctgccttattgcattggtgaatttgtatggaccggattcgattatttaggtgagcctactccgtattatactgattggcccagtcactcttcattgtttgggattatcgaccttgccggacttccgaaagaccgttattacctctaccgcagccactggaataaagatgcggaaaccttgcacatcctgcctcactggaattgggaaggacgtgaaggtgaagtgacccctatatttgtatataccaactatccttcggccgagctgtttatcaacggtaagagccagggtaaacgcacaaaagacctttcggttacagtacataatagtggtgattctgcttctgtcgccaatttcaaacgtcagcagcgttatcgtctgatgtggatggatacgaagtatgaaccgggtaccgtgaaagtagtcgcttatgacaaggatggtaaggccgttgcggaaaaagaaattcatactgccggcaagcccgatcatattgagttggtggcagaccgcagtgtgatcgatgctaatggtaaggacctctcgtttgtaacggttaaggtgattgataaagatggtaatctttgcccgttggccgacaatgaaatcagcttcaaggtgaaaggggcaggtacttatcgcgcaggagccaatggtaatccggcttcactcgagtcattccagactccgaagatgaaagtgttcagtggcatgatgacagctattgtgcaatctaccgagaaagcaggaaagattacactcgaggctgccgcgaagggcctgaaaaaaggtacattggtgatcgagagtaaataatccgttcagataaagataagaaaggaggggatccgggcaaccagataccctctttttttgttatattttatatgcaaaccttaaatgatgatagtatgaaacaacaccgaatcattcacataccaacattcgtcttagctttatttttgatgtttaccagctctgttttgcgagcacaggataagcctgtttggctggcagattctcttattactgtaggatacgccaccgggaataaaaagaatatttccggttcggtggaaaaaattacggagttaggaatgaataaagatcagattaccaatcctctggaggctatccgtggacgtgttcccggactcaccatagaaaaaggaaccaatggtccggctgctttggatgccgtacgtttgcggggaaccacttcactgaccagtggtaacgaccctctgattattgttgacggtgtgtttggtgatctcagtatgttgacttctatatatcctaccgatatagaaagctttactatcttgaaagatgcttcggagacagcacaatatggttcccgtggtgcttcaggtgttatcgagatcactaccaagaaaggaattcggggcaaaaccagagtcagctataacggtagtttcggcatatcctccgtatacaaaaatctggagatgctttccggcagtgagtttcgcaatctggcgcagcaacagggcatttcaatacttgataaagggaatgaaaccaattttttgaaagagatagagcaaacaggtctgcaacagaatcatcatgttgcattttatggtgggacggatgcttcaagctatcgtgtttcgttgggctttatggatcgtcagggcattatattgaacgaggatatgaagaacttcacttcgaatatgaacatgacccagcatgtttttgatgatttcttggtgtgcgagttaggtatgtttggctctatccaaaagaaccataatttgtttgaccttcaaaaaacattctattcggctgcaacttttaatcctacatatcccaatcaccgtaatccggaaaccagttcctgggatcagattaccaatgccagccagatcactaaccctttggcctggatggaagtgaaagatcatgatgcgacttcacatatcagtactcatgcccggctgacctttaacttactgcgcgagcttaaactgattctttttggttcttatacttataatattgttgaaaattcccagtatctgcctacatctgtatgggcacacggacaagcatataaaggtacccggaaaatggaatcactgcttggcaatctgatgttgacctataaaaagaaccggaataaacattattttgatgtgctggccctggcggaacttcaaaaagagacttatagcggtttttacaccactgtgaccaatttcaattccgatcagtttggttataacaaccttcaggcaggtgccattcgcctttgggaaggaacgaactcttattttgaacagccgcggttggcatcttttctcggtcgcttcaattatacgtttgacgatcggtacatccttacggtgaatgcccgtaccgatgcttcttccaagtttggtgccaatcataaatggggcttttttccatccgtgtcggctgcctgggttgtcagtgaagagaagtttatgaaacgtatttcattggtggataatctgaaattccgtatcggttacgggctggccggcaatcagagtggcatcgactcttatacaacgcttaatctggtaaagcctaacggagttgttcctgttggtagttcacaggtggttactttgggtaatatgcgtaataccaatcccgatttgaaatgggaagtaaagcgtacttttaatgcaggtgcggatcttggtatgtttggcaaccggttactcttttctttgaactactataattccaagacctctgatatgctttatctttataatgtcagtgtaccgccttttacctataacactcttttggcaaatataggttccatgcgcaacagcggtacggagattgctgtcggcatcactcctttgaagacccgcgacatggaattgaacattaatgttaatgtcactttccagcaaaataaattgctttcattaagtggaatgtatggtggagagaatatttcggcacctgagtataaaagcctggcaagtctggacggagccggatttcatggcggatataatcatattgtgtatcagatgataggacaacccttaggggtattctacctgcctcattgcaaagggcttatttccgatggcaatggtgggtatacgtatgacattgccgatttgaatggaggaggggtgaaccttgaagatggagaagaccgctatgtggcaggtcaggcggtgcccaagactttgcttggctccaatatcagctttcgctataagcgtttcgatctctcagtacagataaacggggcgttcggtcataaaatctataacggtacttcactgacctacatgaatatgaatatttttcctgattacaatgtaatgaagaaagctcccggacgtaatatcaaagaccagaccgctacggactattggctggagaaaggtgattatgtaaacttcgattatgttacgataggctggaatgttccggtgtcgaagtggaaaaaatacgtccagtctctccgtctcgcactgactgtcaataatctggctactattaccggatattccggtctgtcacctatgatcaacagttctaccgttaattctactttgggagtggatgacaaacggggatatcctttagcacgtacctatacgcttggtttgagtattaacttttaatttggaggattaattatgaaaaggcactatatatattcctttgtctgtatcctgatgtttagtctgctgttttcatgcgatgactttctgaatgaaaatcctaaagacaagattcccgaagaggatgcttacaagagtctcaccgatttgtattataatgcagtggcttccttatacaataacataggaggttatagtgatagtcaggggttgcagggcaccggcaggggaatttacgatctgaatacctttaccaccgatgaggctattatgcctacccgtggaggtgactggtatgatggaggattctggcaggggctttttcttcatcgttggggagtcgataatgatgctattcaggctacgtgggaatatttatataaggttataggtctttgcaatcagtcacttgaacgaatcgatacttatcaggagactcaccatgacacggaacttcctgcttaccgggcagaggttcgtgctttccgtgctttgtattactatcatttaatggatttgttcggacgtgttcctctaattctctcatctgctatacctttgaaagaggtgaaacaaaacaaccgtaaagaagtttttgattttattgtgaaggagttacaggagtctgcccctttattggcgcaaacatatagcaatcgttccggcagttattatgggcggattacccgtcctgtagtccatttcttgcttgccaaacttgtcttgaatgctgagatatatgcggatgataactggaccgatacacaatatcccgatggaagagacatctattttgaagtagatggcaaccggctcaatgcctggcaaacggtggaggcatattgcgattccattactgcggcgggatatcgtctggaagataactatgaagcaaactttgctgtttacaatgaatcttctgccgagaatatttttaccattccaatgagtaagactttatatactaaccagatgcaatatcttttccgttcccgtcactataatcatgccaaggcctacggattgggaggagagaatggttcaagcgctactgtggaagtacttcgaacctttgggtatgatacccaaactgtcgatccccgttttgataaatgttattttgcaggtgttgtttacgatttgaagggaaaggtcatcacactcgatgacggtactttgctggagtattttccttggaaggtggatgtcgatatctccaatacctcctatgaaaaaaccgcaggcgcacggatgaaaaagtatgagattgatgaaaccgccacaaaagatggtaaactgatggaaaatgatattgtactctatcgttatgccgatgttttattaatgaagagtgaggccaaagtccgtaacggagaaaatggagatgtagaactgaatcttgttcgcgcccgtgtgaatgctcctttccggacagctacattagaaagtttgctttcggaacgtcaattagagtttgcctgggagggttggcgcaggcaagatttggttcgttttcgccaatatacccgtgcttatacaagcaggccccggcttccgggtgaggaaagtggctataccacagtatttcctattccggagaaaatccgtttgatgaatcccaatctgacacagaatccggggtattaaaattgcaaaatattatgtggagatgattattgtaaatcataaaataatccatcattatattagaaatatctatttataaggtaaatcgttcttgatacttttgcgtattgatacaaaatcagtgaagtaacattgttttcaaccttatagataatatgaaataatgaagatcaaaacactaacacttttctcgtttttattggcttcctgttcacagcaggttactaagatcgacttgtcgggtagttggcagtttacgaccgattctactcattgggacagtacggtcctgttacccggctccatggcttccaatggcttgggagaagacattactgccaatacttcgtggaccggaggtatcgttgattcagcctatttccggagtgatgcctatgcccgttatcgtgaaccaggtcatgttaaaatccccttttggttgcagcctgtgaagtattataagggggtagcttggtataaaaaagaggtgactgttccggaaggctgggggcaacaggatatcagtttatttctggaacgttgtcattgggaaactcgtttgtgggtagatgataaagaggtcggtatgcagaatgcattgggtgctccacatcagtacgacttatcggatgtcctgactcccggaaaacacacattaactttacgtatcgataatcgtgtaaaggatatcgatccgggtgaaaattcccacagtatttccgatcatactcagggcaattggaacggggttatcggggatatgtttcttcaggtgcgtcctcaggtgaacattgcacgtacgactattttcccggatatatcagctaaaagcattcgtgtgaaaacattcctccgtaaccgtaagaagaatgaagtgacagctttgctcgctttggaggctgatggcaaacttttgcaaaaggaggtcaatcttcagccggggactaatgaagtggaggctgttctggctttgggagatgatatccgcttgtgggatgaatttcatccgaatttatatcgattgaaagtaagtctgactgataaggagcaaaagaccactgattttagtgaagagtcttttggtatgcgtgattttaaagtagtcaatggttgtatcacgattaacaaccgtcctgtctttttgcgtggtgcgttggattgtgccgcttttcctaaaacaggctatccgcccactgacaaagaaacttggagaagaatattcacagcttttcaggcacatgggctgaaccatgttcgttttcattcatggtgtcctcctgaggctgcattttgtgcagctgatgaaatgggactttatctggaaatagaatgttcctcttgggccaatcagtctacgacgattggtgacggtcgtccgctcgatcggttcatttgggacgaaagtgaacggattgtcaacacgtttggcaatcatccttcgttttgtatgatgatgtatggcaatgaaccggcaggtgtggggagtagtacttatctggccaactttgtcacaacatggaaggatcgggataatcgccgcttgtattgtagcggtgcaggatggcccatgttggcggtcaatgattttttaagtgatcctgctccccgcattcagggatggggacagggacttcggagtattatcaacgcagaacctccccgtaccgattatgattggtcggaatatgtcagtcgcttcagccaacctgttgtaagtcacgaaatcgggcaatggtgtgtttatcctaattttaaagagatcagcaaatatgacggtgtcatgcgtcctgcaaatatggaaattttcagggatattctgcaaaataatggtatgatacatcttgcagacagtttcttgcttgcgtccggcaaattacaggcactctgctataaagcagatgttgaggctgctttacgtaccaggaatttcggtggattccagttactgggactcaatgactttccgggacaaggtacagcattggtcggtgtgctggatgctttctgggaaggaaaaggttatatttctcccgaagagtaccgccgtttctgtgctccaaccgtccctttggcacgtttgcctaaacttatttataaaaatgacgaactgttgaacgcccgggtagaagtggctcattatggcgaaactccactaaagaatgtggcagccggatggactttgtccgatacggcagggaatgtactgcagtccggacagtggaaagtagatttacttcccataggcaataacttcccattaggagatatttccgcttctttagctcagatggaaactccccggcgtttggtgttggaggtggcagtcggtgagtggaagaacagttggaatgtttgggtttatcccgctttgccactcaaagtagagggagaagagagtatccggatggtcgactgtttggatgccactaccctaaaggctcttgaaggaggtgcttctgtattgttatctttaaagaaagggacactgacccgtcaaatgggaggtgatattcaggtcggattttccagtattttctggaatactgcttggacaggaggacaagctcctcataccttgggtattttgtgtaatccgaaacatccggctttgagtcaattccccacagaatattacagtgattatcaatggtgggatgccatgagccattccggtgccattaaagtggccgaactttcccctgaaatagctccgatagtgcgtgtcatcgacgattggtttacaaatcgtcctctcgccttgctatttgaggtaaaagtaggtaatggaaaattgttggtatcgggcgttgatttctggcaaaacatggataagcgtgtcgaagcacgccaattattgtatagcttgaaaaagtatatggcaagtccggctttctctccggtcgtatctgtacaggcggagcaagtgctgcaattagtctctgataaatagaatattctgttttatataaatttgcccgggcttacatctttcgatgtatacccgggcaaattttatgagatattctctgtgtaaatcagtgtgatcggcggtgaaacttcttagtcgaaaagacttctgaacttcttgaatatcttttctttaattgaagtacttggcttgaagttcttcgattcttccagcttttccaaagtacttttttcgtctttactcagtgtctccggcacatatacacttacgttaaccagcaggtctcctgtgccgtaaccgtttacacttggcaaccctttaccgcggagtcggagcacttttcccggttgtgtacctgcttcgatttttaccttcacttttccgtcgatggttggaatttctaccgcacctccgatagctgctgtagggaaactcagcaataagttgtataccagatcgttttcatcacgaatcagctccggatgtggctcttcttccaccaaaatcaataggtcgcccgggataccgttatgttttccggcatttcctttgccgcccatagagagttgcatgccttctgctactccggcgggaatttttactgttactacttcctcaccgtattcgataccttctccaccacaaaccttacatttgtctttaatgatttttccctcgccattacaagtaggacacgtagtacgtgtctgcatggttcctaagatggtttgctggttacggattaccgaaccgctacctttacaggtcggacaagtttcagaaccgccattaccttctgcccctgttccgtgacagtgcgaacaaggtacatatttttttagtttgaatttcttttcaactcctgtagagatctctttcaaattcagcttcaccttcacccggaggtctgagccacggaattttctctgttgagaacctccgcctccaaatccgccgaagcctccgaaaccaccaccgaatccgccgccgctatggccgccgaaaatatcaccgaacatagagaagatgtcgtccatggacattccaccaccgaatcctccgaacggtccgccgtttccggctgctccactcattcctgcatgaccaaactgatcgtagcgggcacgtttatccggattgctcagtacgtcatacgcttcggctgcttctttaaacttttcttctgcttccttgtcacccgggtttttgtccgggtgatattggatggcttttttccggtatgctttctttatttcttcgactgttgcctctttcgtgacttccagcacttcgtaataatctcttttttctgccatattttagtttcgttgattttaattatgttagcaagtttgtcgtgtcccggttattcacccacaactacttttgcatggcggattactttgccgttaagggtatatccggtctgtacacaatccagtattttacctttctgttcttctgtcggagcagggatcacagcgatggcttcgtgataatccgtatccagcggttggtctttggtttcgataacctttactccatcctgcgacaggatagacaggaacttattatatatcaactcaacaccctcttttacggcagctacgtccgtagccgtttccatagttgtcagtgcacgttccatgtcgtcgattaccggcagaatacttttgatgctcttctcaccaccgttcagaatcaactctgctttttctttgatggtccgtttacggtagttatcgaattcagccgaaagacggagatatttgtccttctgatcttcgatctggctatgggcttcttccacttctttttctaatttctcctctgcggtcagcggtgtgctttcctcagtggtttcttcgttttgcgactgtccttcaacggtatcctgaatatcgtctactgtcaactcttcttctttcttggtttttttttcttttgggtccatatctattctgtttttattcttgttaaacggatttagtttcatgtcaatacggcattttaatgtattggctttgcagcaaaaactttgccagtttgtttgttttgccaaaaaacgcagcaaaggtaatacttttatgtcagattgacacattactgatagttcgttattcactaaaaatgtctacctttgtcaccgcattatttgataataaataaattaaggaataataatagaatgattacagtttcaaacgtttcggtacagtttggtaaaagggtattgtttaatgatgtaaatctgaagtttacaagtggaaattgttatggtattatcggtgccaatggcgccggcaagtcaacttttctccgtacaatatacggtgacctcgacccgactaccggaaacattacgttaggtccgggcgaacgcctttcggtattgagccaggaccactttaagtgggacgcttatacggtaatggataccgtaatgatgggtcacaccgtgttgtgggatattatgaagcagcgcgaagccctttatgccaaagaagattttactgatgaagacggtctgaaggtttccgaactggaagagaagtttgccgaacttgacggatggaatgctgaaagtgacgcagctatgttgttgagcggtttaggtgtgaaagaagataaacattatacattgatgggtgaattgagcggtaaggaaaaagtgcgtgtgatgctggcacaggcattatacggaaatccggataacctgttgcttgacgagcctaccaatgacctggatatggagactgttacctggttggaagagtatctctctaatttcgaacataccgtgttggttgtaagtcatgaccgtcacttcctcgattctgtctgtacacatacggtcgatatcgattacggaaaaatcaatctttttgccggtaactacagtttctggtatgaatccagtcagttggccctccgtcagcagcagaaccagaaggccaaagctgaggagaaaaagaaagaactggaagaatttatccgccgtttcagtgccaatgttgccaagagcaagcagactaccagtcgtaagaaaatgctcgaaaagttgaatgttgaagaaatcaaaccgtcctcccgtaaatatccgggtatcatctttactccggagcgtgagccgggcaatcagatattggaagtttccggtttgagcaagaagaccgaagaaggggttgtattgttcaacgacgtgaacttcaatgtggagaaaggtgacaagattgtgttcatttcccgtaatccgcgtgcgatgactgctttctttgagatcatcaacggtcatatgaagcctgatgcaggacatttcaactggggggtaacaattacaactgcttatcttcctttggataataccgaatatttcaatactgatttgaatctggtcgactggttgagccaatacggcgagggcaatgaagtttatatgaaaggtttcctgggacgtatgcttttctccggtgaagaagtactgaagaaagtgagtgtactttcgggaggtgagaaaatgcgttgtatgattgcccgtatgcagttgcgcaatgccaactgtctgattctcgatactccgaccaatcatctcgacttggagtctattcaggcattcaacaacaacctgaaaacctataaaggcaatatccttttctcttcacatgaccacgaatttattcagaccgttgccaatcgtgtgattgagctgactccgaacggtattatcgataagatgatggaatacgacgaatacattacttccgatcacatcaaagagctgagagccaagatgtacaagtaatgatgtacggttttggacgatgaacgattaacgatgaacaggttgtgcctgaatgggcacctgttcatcgtttttttgttcgcattcactttatttatcgtttactgttgttcatcgttcatagtttatcattcatcgttattttacctttctccatttattacgtatcatatataaacaacatataccgtggcttatggaacaaaaggaaatacaggcattagtagaaaggagcaggaagcaagatgcaagtgcatttgctttgcttgtggcagagtatcagacttttgtttttcgcctggcattccgcttgttgtgtaatgaagaggaagcgcgggatatggtacaggagactttcctgcgtgtctggctttcgttggacaaataccgtcctgaatttcgctttgcgacctggctttacagggttgcgtgtaatatttgttatgatcgtttgcgggttttacaacactcgccggccggagcgctttccgatattgcgttttccgagttgcccattctttccgatgataacgtcgaagcagtgttagtcaaccgggagttgaaagcacatatcctgtactttatgcaacaactgactcctaagcagaagctggtatttacattgcgcgatatagaagagttggaaatcaaagagatcgagattattaccggacttacatcgatccagatcaaaacaaacctctatctcgctcggaagagtatccgtaagaagttgaatgaaataaataaagaaagatgaaaaaggaagaaattaattatgaaaggtggttgggacagttaaaaaagacaccccccattctggaaaatccggaggcattgaccgaagatattatgcgtgctgtcaaggcggcttctttcagaagtccggccaagcgcagaccgaatcttgttgcctggtgttcgggcattgctgcaactttgctcttggcgatatgggtagcagaaacgatgtctgttgattcatttccctcgtctgaagtaatcatcataccggagccctatcaatcgaatactttcacaggcagtctggagcatagaggtttgacgataggagagaagcaggaacttttctttaccgcatcccgtaatcggaaaagggaaatgcttaaacgagaacggctttatactcagtataaacagataatgaagagtgagtgatctttaaaaaatagatgcgtatgaaaacaaaaaatcttttaccgatattgttgctggccgtttcaatggtgtcctgcaccacctattatcaagtgaaaacccaggtttttcctgatggatcggctcgtagggaggtttatgcctttggcgattctgcattcatggccggaaatcgggcacaaaatccttttatgttctcattggattccggttggacggtgacgcgttttgattctgtccggatgcataattattttggagagaaggaaaagataaacgtgtgtgccagcagggagcaggcttctgtcgacttattttcggagcaggtccggcctaaagatccgatgtttcgtcctttggtgactccgcgggaaacactgaccaaacatttccgttggttctatacgtattatacctataacggtgtttatcccgaactgacagaaaaagggcctgtacctctgaaaaactatctgaacgagtcggaacagaaactttggtttcagggcgacgacactgcgtatcggggaatgaacggattggagatgaaagaagtgctcgatcgtttggaaggacaatttgttcaatggtacaaccgtagtctctatgaattaagtcttgaagtgatgcggccttttatagctgacctgaagcagggtgactatctttcacgcctgaatgcggctaaggattcattgtatcaggcatatcggcctcagaatgatgatccggacttctctccggcactcgtttgtcaattacttgatactcactttcatactgattgcttttcgcttctctataaagaaaaacagcaggaagtggatcaaaaatttgatgaggaaacacgttccgttgagttatttggagtggtgattcaatatgaactcaatatgcccggacaaatgctttcggcaaatacaacctttagggaggatggtcattgggtctggaaagtagatgcctatcgtcttttggcaggcgaatatcttttgactgccgagtcgcgcgtacccaacatctgggcctttatcctcaccggcttgcttattcttttgggtataggttattggataaaaaagcgatgaacaagaaggagtgaagttgtgtcaaaggtcctctcaccacagattgcgctgatttccacagattattcgtgtcgttaaaattccttctgtgttcctctgtgtcctctgtggtgagttttttgatatgctcccgtttttttatcgtttataaatcaacttatttttcccttccccgaataaattgtctcctatggttgtgattttatctcctttggcaactacgtagcgtagcctgtcacatcccatgaaagcaccatattcgatggctgtaatgctttccggcaattccacggttccacacagacgtccgcaattgctgaaagcccgctgtccaatgcttttcagtccatgaggtaaacgaacgcggagcaggtattttttttgtgagaaagtgaagtccgggatagctgtcgcattggtcttttcgatgtctacggcaaccagattcggcatataatcccgtatcagtttaaaatcggctgcatccagtttaccttcgatggtcaggaagttgatctctttcggttgtagccctgctttttgtatttcactttccagtgtgctcaaagcacctacctctattttagcttccaatggttcgccttcaatgaacgcaaagttatcccaacgatttttcagccggtattcatcacttgctcccagtggtacgaagattgcagtgatgctgtcagccaaagctcccggcagcaggttgggaggagttttctttttgatctggcagatgttcaggttctcgcatcccataaaggctgcatcttcaatgttcttgattttttccgaaagaaccactttctttagggtcggtttccctttggcaatgccgttttccatcttgcagaaagcataggccggaacaaagtttggcatgtaaatatagaatttatccggatacgtaccttcttttcccgaatacatactgatacttgcattcgctatatcgagcacttgcagatttttgaattcatcgcgcagatgcttgaagtccactgcgttgatctttcctgtcagagtgaggtgagtcacctggtttgcttcttcttccgtcatcatcgaaataagagttcccggtttgctgacgaaatatgttttcttaacttcttgtgctgtagctgcaaatagattggcagcaagggctattcctataaacagatgttttattttcatatttatgataaatgtttagacaaatatagcgaatcatactttatctcgttgagagttttaggaaaatatagttatttttgtccttcaactaataaattaacaaaatggaacaacaagaaaaaaataacagtccgatccacccttcgggaggaattccggcatttgcaagtattgcattatttctggtgggtttctatattcttatgcctctgtttgggattatcctgagttctatccctgtattaaaagagtggagaatgggggctttctttattggggagggagctatgttgctgagcgtatttattgtaaccttcctgatgatgcgatttcttgatcgccgtcccttctccgatttaggattcagcctgaaaagacgtggtaaagatatcctatacggttttctgatggcagtgcttatctatgccattggctttgctgtttgtttgctgaccgggcagattgaggttgtcggtgtccatttgcattggaacgatttgctcttaagcgggttgtttttcgccatggttgccattgtcgaggaaactatgatgcgcggatatgttttgggacgtttattgcgtacgcgactcaataaatttatttctctcttcatctcttcccttttgtttgcgttgctccatctgatgaatcccaatgtggcttttttacccatgctcaatctggtgttaggagggttattactgggagcttcctatctttacacccgtaacctttggtttcctatttcgcttcatttcttttggaactggattcaagggcccgtgcttggatttgaagtcagtggcaatcgtttctgtgaaaccttgttttcacttcgcctgcccgcaaataatctgatcaacggaggagcatttggttttgaaggttcgctggtttgcacggcattggcaacgctctttacactgctcataatctggtggtttgaacaataaaaaaatgtcccatgttccgctgaactctgggacattgataaaacaaacaccacatttacttcacagtaagtcagagtggaaaagcaaggacgcatttacttcgcagtaagtttgttgcgcactattaaacacaaacaaaacaaaataaaagctgtacaacagccattataacacttgcatcaatgtaggtttatattaatttgtccataagagagagcataaagtatgtgggggtgaatcttattctaaaatttatacgttgttcccaccattaaccccactgttccccgtatgggttcctgaaggtctgcccgataacttctgtctttaaatatattgattcggggttccagccaaagcccggtatgcgccgacaacctgatttctccctgtagtccgatgcggccgttcaggatgatggaagatgatgattccgttccgggaaaatagctcccgatgccacctgccactgtcaggttgaacacgtggctgtcccggtcggaaaaaagccttgtgaggttgcacagatagtcgatgttgaggctgatattaaaatcgcggttgcttccgctttcttcattatctaaaaaggcggtactactgccggcactgatccgcattccgttaattttgtcgaaccatttacctaaagcgaattccgtgtcgaacaatacatttccggtgtttcccgtgccggccgccagtgaggcaaaacctcctttaaggaaggtcagggtagtgtatcctgccggtttgtaagtaatacctgccattagtgatcctgccaggttatatcttttccacgatggctggttgtccacccggtccggataaagtgccagttgtggctcgataaacaggttaaaagcagacgatacattcagtttcccttgtaatcctgccctcaatccgtatgaatggattgttttttggtcttttacgatagtggcctgatagctgagtccgagagcgccgatcacttcgaatacccgcttcgggttgtatctggcggcaaatgcactgatattgatcaggtagtctacattggctcctgccagatgcatatccgtatttccttgtttccactgtgtatattctcctccggcccgtaatcctatgacgggagtcagccaattgcctgccatgaatgatgcccgtggtccgtgagcggtttgtccgtctcctacgttaaacagataaccgatgcccgatccgacagagaaaaacagatgttccgaccctctcttcgaatggaacttttctgctccctttcttttgggtatcaaatattctgaggcctctatattgttttttcccgctgttgaatcttgcttttgctcttgtgctgccagagttccgcataagccgaaaccgactcctaacagcaggattcttttatagctctttctcatattcttcattgctttatcgttctttcttcattcaagccgttctcttccgtttcggtgtcttccgtttcggttttttcttttgttttctccgctttttccttctgttctttcttttcctcttccaactgttgcagtaggtcggttacgtctccgtctatctgcgcaatctctttcagtgacggatcttcgttcagggcccgttttatgaaagcatatgcttcgctcactttgtccaacctgttggcacatgccgcccttagataatagctgagtggttcatccggtagttcttgtgccttttcccacgcttcttcattttgcttcatggccattaataataccacttcatttatgccgccttgtgttccgaaccgttcataagcatcctcaaaatgcccgttgtaagctccaacgatggctcttacgtcttgtgtcatgtcgttgtccggcaaaaagtctataatggagtccgcccggttataagctctttcgtccattaaggcgattacctgattacagagtagttctgtgggagccgatctgctgacaaacggttccagtaatttgctgtctgctttcttttgttctatcagtaatgcagccaattcgttggccataatcataaatttaggatattgttccagtgcctgtcggcagatcacttcgcgtgtagagtcattatcggcattcaggtatatccgccaaaattcatagggcaccaattttttatagtcctgtttatacattatgcgtatttcttcatcgttcagcaatctcatcaccgaatagttgaaactatattccacccggcgcagccgtggtaagtaagtcgttagaatgacattccggtattccggtagtcgtaggatccggctgtattgcgaggccatgttgtccggatagcaattgatgatttcccgtaacttgcctgtaggcagtgagtcgcgttccatcaattctgctacctcttcccaagaggccaccactccctctgtatatgtactgtcttttattgcgtttatagtgcctccgttcagaaaaccaaagatacgtttcagcgtactgtccgtgcgtttttgtgccagtttcagattcgattgatacggaccttctggcgacgatactcctttgaccgaaaacgacaggaattccgagttcggatcgttttctatttcctgcaggcgcaagcgcattttctccagttctctttggttgttcggatccttttcgtctatcgttgccgagttgatcaggaagttcagcttcacttctcctctgtcgcctctttgttgtttttgaggtttagggatgtatttttcatctctgattttcatgccatccgcctggtacgtaaagaaacgcatcggatttaccgtacctttggctatcactactgtatctttgtatgccagttttttatattctaccagatacatgtagatgtcacaccggcattcatcgtctgggttatccatatagagggagtctacgtaggcaatcacttcatttttatcaatcttttgcgttttctcctgaaaaggtgctaacgggtctctgctcaggtcgaattccatcattcgttccaatgtgatggcatactcctttccggtcaccactgccgggcggaacaggctctgtgttttacgggtaatattcaccaacatcggttgcactacgatacgtgtgttcggcttatacatttctttgggaatttttactttagggtggatgatgtattgatttccgacgatctcgatgtcggttggttccggtagcagtttgtccaccacttttttggcggtgatcaccacttcgtcaatcatcgatgcttcgtacgagattactacatttatcgttgtctttcctttaagttttactgtttttgatgcgtaggcaaagcccgagaaatggagggtcgtactaggatctgccatgatcttgaactttccgtccaggtctgtgatgccgtatacatctcccttttcattctggtctctgattacgatagagatggcaggttctccctcatcatcgattacgcttccgcgtatttctactttctgggcttgtccccatgccggaataatggcgtatagggccactatccccaatagcaaaaatcttttgatgttcattagggttattttatttggctatatagataaaagatacacttagtttaaccggtatgggggcccatcccgattcattcggttcaccgtgagtgcttcccggttggtagcgcaccaacctgtagcgtgccacacccacaccgcctgaaacctcaaggttccagcggcgtgacagaatccagttgtatccatacgtgacacccgcagctacggcatctccataatatgccctggggtttattcccacatcgaacatggaatagaatcctgtgataccgatgtaatggcgtgccaacaggtttcgaagccaatattttgcttcagcctgtacgcgtccatgacggtagaaaagtttatctgtaatctttcggggattagccgatgccgaaatctcggctgtcatccaatcgtttagcgggaattccactcccagattgggagatgccgccaaccattccagcgtattggttttgatggccaaacgttgggcggatacttggaaagatattgctatgaaaataaaaaatagaacccacttctccaatagagacgggaaatcatgtccagtcatctcccacaacaggttggggaaatttagttttaaattaaatgtattcataaacgcgctcacttctgtctaaagcgtgctgtcgtttattcttgttggttgcaaatatagaggttttaatttacatttttcaactaatcgaaatctttttttataagttccaataaatattcctgtaaatcagtctcttgccctatctgtaatttttgccggagccggctccggttgcttctcacggtcgaaggggctatatattgaagttcagctatctcttcggttgttttgttctccaatatcaggcagcagaattgtatttctttgttgctgggttgaaggtgcagggcgttgaaagccgcccatagctttagttcggaagtcatccttttttttgccggtgcatgcttcgcaatatttcctgtaacttggcgagcattaccggaggaaaaatataagctaccgtcaggctgggaaaattcataaggtagaggtcggacgatgtatagagtccgatgcccaggtagagcaaaaccggtgagagggataggattatgaccgtgtggcgttttacggaaatggaagccagtccgcaggtcaccattccgataatcaggtcctgcgacaaaaagaatccggcttcttccggcggtaggtagatacggttatacatcgagatcagtatattgccttgtatcgtatagaaaacactgtttagtagagatacgatccgggcttttttccgaatcagtaaataagtgaataacgcaaataatcccagggagagtatattgcatattgccagcaataagttatttcgcatgaggtagacgcaaaggtcggccaggattccgatactgaagcagaccactgtactataatagatgtaatagatcgtttgttgttccgcactttctatattcttgaactggtggtattttctttgcagatactcgtttcttttatgaaaaggaaggcttttaagattcatatttatgtttggtttcaatgtcagatgttggttatgtcctattcgcacaatgtttgcgagtcccgtggacaaaactctcacagcgtcctttttcccccataataaatgtgaataatttcaaaatcaattcaaacatatatatattaaaaagacgtagtgcgcccgccatacgtcatcaaggctcaccacaagcctgcttactcaatggcagtgcaccacgtcctgagacggtacagttaccccaatgagtaagtctattatagcctttctttggttatcggaggtggtgattctgatgacgattaggctatcgtttatgttgctaaaaccgatttgtttctccggccgcatataattggggcaaagatacagataaaaaatgaaaactttcagaaatgtttttgataagtagaactcctgatttgcttaaatatgaattggctggtggattctcttccgagagtgtgtagaggacgtattgattttccttcaaattctaactatttgctttgatatttccttttttgctgacgcgtgcaatgctccgttttcttggaataggggctttgcggggatataaagacagatgaaaagagagtttggtagtaaaaaagaaccggatattcacttttttatctataggaagttaactttgtaattgcacaaagttaattctttgtcggcagaaagttagctttgtgccggcaggaagttaacatctaaccggtggcaagttactttgcagccgataactctcttttttctttcggaaaaggggcataaaacactgcgtatttttctggttgcttctcgtctatgacttctctgaatatatgaaaatgatctataattggaattatatttatcttttatattgcaatcggttacgtatgccgattttgtggattgcgtattgccttatttgctttcttttcgatttactctgatacggattcttgagcttcttttgattaaccttggaacttggacggaaaaaatgaattctataagctatagaaaatacaaaatgacaattttcagattctattgccaaataagtgattcgattgatctacgagagcaaacattacgctttgcagtgcaaagataagtgctgcttctgcgctttttcaatgaaaggaaagcattctgagtgttatttatagttgaagtctcgataacttctgattaacaaatagcaggtaatatggggttcatgttttcttatcgtgtatatacttttcatatatatcgcgtatatggcgtaggttattgtttgttgtgctaatcgggtagtcgaaagtttagatcatatgataccccataatatccatgccttttttatccggacagatttttttctcttcccggtgaaataaagaaaatcatgcaggtagttcaaaaatagcccatttcatcgatggaaatccggtgttgcatatttgcgacaccctgaaaaagagaggtgttgcaaaaatgcaacggctatttttaggtcgtttccgggggctgggctacatttgctcctctcttcatggaagggagtacaaacaaaatgtataagattttttaagatagtgaagtcaaaaagctgccaacatattgatagtggacgttgttatacttttgcaaaattttcaaaagtaaaaaagaagatgacctccatcactccacggctcaatcgctcgcgcgagggtcgtgatggcagctatccactcgtgatacagatcatacgccatcgaaagaaaagagagatttatacgccttaccgattttgggaggcagagttcaacacccgtttagaaatggtagagaataccggtggcaatcgccgtcgcctgctcactgttcgcgaagccaacgaataccttatatatataaggaaggagttgacagctatttgcgaatcgctggaagcggagaaggggagtgcttatacggtggacgacattgtacgcgtctacaactatcacaatgatttgacccaggtactggtctacgccgactccgtgatagctggtctggaaaataaagggcgtcagggcacagccgccaattaccgtagtgcccgccgggcgttcgagttgtttgtgggtgaccgtcctttctcgttcgaagaactgacccccgaagtaatcgaccgctttgccgacttcctccgcaaccggggcaatcagccaaacaccatttcgttttacctccgccagtggcgtgccatctacaatcgcgcctgtgccgaccacttggtttatactgatcagaaacctttccggaggctgaaccttaaagaagaggtgactgccaagcgtgccatttcccgcgagaagattgcacggatcgagcaagtcgatttgactgcttcccgtaccgatatgcagttggctcgtgatctgttcctgttcagtttctatacgcgtggaatgtcttttgtagatatgtgctatattaataaagaaaatctgcaaggagactacctttgctataaacggcagaagacgggacaagagttgcggatacgagttgaaaacggtttgcgtgagttgattgaccgctatgccgattcttcatcggattatctgctcccgatgctccgccgtggtgacagctatcaggattatcgccgacagcaacgcaagcttaataaacagatccgcgaattgggtgacaggcttcggttggaggtgccgcttacgttttatgtggcccgccactcctgggcgacccttgctcatgcgaacgatatacctgtctcggtcatcagtgactgcatgggacacacatcggagaagactacacgcatctatttggatcgtatagatactacgcggcttgacagggccaatcggttagtgataaactgtcttcggtaaagagggggtgagaaaaggacaaaaaaaactctttcttataatgaaagagccaaccgtgagataccctctgatctcaaataacttttgcaaagatacatattaaattattaataaagcaaatctttttttagttttttttgtttttgctgtcaattatttattttctctttccatatagaaaaaaacatcctcctgtacaccttctttttgtctacagactcttctaagaaagcatacaccggtttctcgctatttcttttccaacggttttcatctgcccgtccccactgcttcaggcacatgccgttatttattcacaaggatgattaatctgtttataatcagatatatgcaggttgtacatcatccttcgtgttgctcttttacggccctttccatctatgtttctgaaatcgtttctgagtcaatatcaagcaatgctctatgaatcagtgctttactttcatacttcctgcaattgtttctgaaaataaaaaaaatcagaaacatttccggatcggtactcttttatttttctgccttacagatggttatgttggtaattctgaggcttcccctttcattataagaaagagtccctaattatcaaacaaaccataaatatgaaaaaggtactatgcacattgggggtgattgttgctttacttttatcgtttccttgtatggggagcgctcagcagtggggcttgactgccaatggtctttactgggccacggctactccgaatgtaggagtcgaatatgcttttagttcaaagatgagtgtagccggtcttattcaatataatccttttacatacgctaaaaaccggaaaatgaaacatttggtcgggcaggtagaataccgttactggctgagcgatgttttcaaaggtcattatctgggtgtgcatgccacgggaggtatcttcaacttcggtaaccttcctttgggtattctgaaggactatcggcttgaaggccagttgtacggtggggggcttacttatggttatcagtggattatcagcaaccgggtgaatatcggagtcgatatcggtttggggtaccttcaagttgattatgataagttttattgtcctacctgcggtgagcgtgtcgatcattaccggaccggttacgtaggccctaccaaggttggtgtgtccattatctatcttttaaagtaggggagggataaaacatgaatatcaggcaagtttttttcataagtttctcatttttcatctctctatcagtgttagcggcagatagatctacgcagcctgtccgtacagaggtgtatcgtttggaacgccgggactctgtcttgttggtcgatctggctgtcgacctgaccagcgtccgtctggcgccggactgcacggtctatctgtttccgctactctcttcgggcaatgccgtcgattcattgtcgctgcctcccattgtgctcaatggtcctcaaagcgacttgatgtatcgccgtcgccgggccttgggcactacttctggattggagaagattcctccttatactgtgcttcgtgagggagatcacgccttgcctcacattcattatcgaatcgaagttccttatgcggcatggatggaagatgtgaaagtgtggatgcgggataccaattgcaattgcgatgcccgcctggtaccttttgccatgcagacagagcagataccgccattgattgtagaacgggtggatactattgtgattcgtgacaccgtccgggtagttccgaatgtatctgagcggctacctgtggttgcggatgcctcttcctataggaaggcggttcctattcaggcgggctatgaagctgatatttattttcctactaacgaaatgcgcattcttcccgatcatgagttgaaccgtgcctcttggatgcatttcgttaatcaggtggactctattgagcgggataaccggaattccatatcaggagttactgttaccggctactcttctcccgaaggatatgccttgaataacgaacgtctggccgagaagcgtgctaaagctcttcaggagtttcttgaaaataaatatggcgaacgcatggagatcgcggttgagtgggtaggcgaagattgggaacagtttgagaaagatatagaactttccgaccttccggagcgtgatgaaattctttcaatcctgcgtaccgtgaaagataacaatcagcggaaaaaatctttgaaaacgctgaataaagggaaaacattcgaagtcttgctgcgggaatattttccgaagctccggcgagtgtcatgtcgtattagatacgtaaaataagaatatgaaaagaatgtattacataggatatatgctctgcttgttgcttgccggttgtgtagtcggtgagaaagcggacggcctgttggagcaacgtctgtctgatcgtacccttttggtttatatgggaggggataatgatttagccgacgagaccgacgaaaaattatcagcgttagcagaggcgtgggacaggtttccggggcatttattgatttatcaggataaaaaaggagcggatagtacccgcttgttagaggtttgttttgatgaacagggagaaaaggtaacaaaaatattggctaagtataaacaggagaattcagccagtgcctccgtatttgcacgggttgtcaatgaggctatggcccggtatccttccgttgatccgggattgatcgtattttctcataccagcggatggctaccggtaggtacggcagtggttccgggcggtatgacccgttcggttgtcaaggataatcattctgaaatgactttacaggattttgcatcagccatcccggacggccagttcaatttcatccttttcgaaggttgtttcatggccggacttgaggtagcatacgaactgaaagataaaacacaatatgtggtcgggtcatcggccgagatgctttcaccgggcttcactccggtatacaaacaaatgtttccgttgctttataaaaaggaagcggatctgtcggcagtggctgccgcctattatgattattataacgatctggaaggggattatcgttcggctaccatcagtgtgatccggactaacggtttggaaatgttgaagtcgcaacttcgtgcagccgagagtcgggtggagcgttgggagtggatagaccgtagcggcttacagagttttgatcgtttgccggatggacaacatctcttttatgacgcttcggcctatgtagaaaggattggaagcgttgaagaatctgccgcttttgatgaggctttggagaaagcgataatctataaagcggctacggagaactttatgccacagagccggggcggatttacgattggcggtcattgcggcatgacattgtatatacctgatgccaccgctcccgcattgctggccgaaagaaagaaattgaagttaatgcaataatatacatagttcaaattaattagtgaatggtaataatagaattaaaaaagtgatggaaaggaatctttgattaacgaaacagacagtgacagttaacagaacgatggaacagggagtatccgcatttttctctctgcctttcacccttcgcagcctggaggggagaaaggaataaccaaagcggataagcacattaaatatttcaaactcatatttataattaaattttttagtaacatgaaattaaacaaattatttacatttacattggcggcccttgcaatggctgcatgtagtaatgatgatgaaccgggaattggcggtggcggccaaaaaggtgagattattgatgccatcagcattgcttttaccaattctacagctcctgccacccgtgcggataaaggtgaaatagaaggagtaggcactgaaaataacgtgtatgtggcctatttgtttgccaaagaaaatgatccgcagcatgaaggtgcaaaagtaggtgactggactgtgaagcgtgtggcaggtgacagtaatacggaagacactgatgtggcaaccgcaattggtgagggcgatgttgcgactcccggaacgaagaagaatatgtgtacgtttaacggcgtacgtcagggagatagcgtttatgtcatcgtgaatgaccctcagatgacccttgctaccgctcagacactggcacaccaggccgacaaatcggaagccgctatccgtgcctacatctctaatctgtctaaaagctatctgaatgacctgactgttgttaaagacggaacgcagactaagaaatatatcatggcaggtgtatcggctattcctaccaacccgaatatcccgaacggatctaccgttaaagtttcgattcctctgaatcgtgaattagcgaaggtattctttaatgcctctgttactaccaatcccgtatacgaggcttatggtaagatggcaatcaaagatgcagattgggaaaatccggtaagtactaaagatcccgatggtattgtcgtagtacgtatcccgagacgtgtttctccgttcacggcacagactcgtgactggtatttcccgcagagtgcggatgcaactgttaaagactgggatgtggaaggctggttgaaagcatttgccggtgagaaagaatctgcacccagtactgcagaagttgctggaactccggcattgaataaaggagaatacaatgctgacgcgaaagaatatcgtctgacatgggttgttggtgaaaaggcgctggctgatggagctactcctgcatctgcttcgatggtatacgttaagagtgacaagttatattctccttatttttatgtaactcctaactatgccgataatgccggttgtgctactgtggtagttacccaggctacttatatcggtacacataccctgcttgaaccgactattacggagcaaatgttgaaagaagctttggcagatggcactttccaaggtgctacttctactgacggatctgtcacctatgataaattggctgctgatttctgggataaggctgataatgtaacagcattggttgcgttcctggaaacgaatgagacatataaacttgcgttgagaggtgaaacggaacaagctaagaaagaagctgctattacgattaaacctaacgacaaacgttactatcgtgctgatgttgctaactatagcgatgacgaaacgacctcaatgaagattaccgaacgcaatacattctatcatattacaggtactattactactttgggtgccaagagtattgaagatgctatcaattcggataatattgacatgcttgtacaggtagttgttaagccatggaaatatgttgttaacaatataaatatgtaatcagaatctcttttttatatgatccggggcgggcagaaaatccgctccggtttatatccctttctttttcggaaagggaagaatacaaaactaaaatgaagaaactgctaccgatacttctgggtgttgccctattgctgaattcatgtattaaagatgatatggatgcttgtgccggatatatgcacatctatttcagctatatttatggtggagccaatcgtttttttgaaacggtttctactcctacgcaacttcatttttataaacagaagcataaatatcgggaactggaaataggtttggacgaagtaggattgaccgaaccttatcgattcttgaaaacctttgatgatatagacagtctggaactgatagcctggacacatgatgaggcaattgattatgtagatactcctgatactcccataggagaggggtatgtgaaattaaaagaaattaccgacggcagcggaatctgccggcctgtagacgatctgttgtacggacgcattgccatagatgccggtctgcgtgaaaaccgcaatattgtgaccattccgtttgtacgtgccgtatgccgtacgcgtataacaatgattcctcagacagtagaggataaggtcgttgaagaaggaggaacaacacgtgccgcgagcagtattattccttcccccgaagattttaagttccacctttacggtacgcgtagtggtgtagattataataataaagcaaatacggacgaagtgatacttgaacctgaatgttactacgaagaaagtaccggaaatgtactgactccctggttcggttctttttcatcggaaggaaagttcctgaaggtagatgtgtttattcgtgatgaaaaggtcgcttcgtttgattgtgctcctattgagttgacttctgttccgggcaactatgttgacttggtgattgacggacattatgtgaagcccgttatgcaggttcgtgtcaatggatggaaagtggcggcaatagaaagtaatatgtaagtaagctgataaaaggagagtatagcatgaaaagaattctgatatgtcaactgatggtatttctggccgtggctttggtttcgtgttcggatgatacttccgaaagtatctctcagagcccggataaagacatgtacctccgtgtgaatgttccccgcacgtatgcttccggagccgatgggacggataacaaagagacggtgatcaatggcattgacgtattggtgtttgctccgggagtagccgaccgggatcggctgtatctgaaatcagcatccgaaggaactccggttgccggtaaaaatacgtttcaggtgactatgcctgtgggagaaggattggaagtgcatgtatttacgaatagccatgcagagttggtgcgtagcggtgcctataaaggtttagggatggagatgaatgcattattggaaaaaatggtatcccaagtggagaataatctgtccgggatagactgtttgcctatgcatggttttttgtcaggagtgactgtttcgaaagagtcggtaggacaaacgcttagtgtaccggtgctgcgttcggtagccgctgtacaggcaaaagtggatgacgcgcatacgggaaatccgggtgagttgttggatagcgatggtaaggtgatttttaagttgcgtgagttttatgcttatttcccggcggatagcggtaggttggctccgttaaaggaggcctatgaagtggttaccgcaggttcagaagacgagaaaaagacccgtaatgtggttaaaacgactttacccgccaaattaggggttcgcccgataggtgacaagctttttttgaagagtgagtcttctttgctccttgccggaccgctctatctatacgaaaacacttattactcggataacggctttgatcagcccggatatattgccggtaacgacaaagtggctaccactcgtttggtggtaggtggaatttatggagacgacgcggatgtcacttattaccggattgatctgacggatccggacgatccgaaaaaactggttgaactattgcgcaatcataagtacacttttcagattatgaatgtctcgggttcggggtatgacaatcctgacgatgcggctacgggggtaccgatgaatatctatgtgaaagtgattgactggatagacgtgaatacggaaattgattttgaccgtgagaactggttctcttcgggtacaaagaagctcgttttatccggctacgcaggttcgctgaaatccattcccatagaaagtgatgttgcgttcggtcctttctggcagttgagttttgatgcgtcgagcccggttaacggtaatgcgacggttgcacctgtaaaggtatctgacggtgcagtgtcggccgtaatctctaatgaacgctacgagataactgtcactgcgggtacgcttaccgtaaaggccaaaaagtcttatggggaccttgccgccggtgaggcttatgacgatgacttctatataaaagtaaagaatttgacagtgcattataaactgactcaggtagaccgttctcccgatgattggggaaacggaggaagccaggaagatgaattgcataattaaacatagattagttggcttatgaaacgatttaaaagaaatatacggcaaggatgtatgcttctaagcgtattttgcttgatgggggttacagcctgttcaagtgaagagggacgtgatatgcagcctgtcaagcctgtcgctttcacgctgaactataccatccccgatgctgatgatccggaaacaagggcatccgatacaggagggaaaatacctgtggcccgtccggaggaaagtgtgataaatgatgtaaagctcttatttttcatttacgatgaacatggcaacgggttgtatgccggttccttgcagggaaccgtcgatggcaatcatctggctaagacagggaaaatatcggtaattataccggaaagcggaagcatcgacaatcatacggattataatgtattggtgcttgccaatgcttctgcttattttcccggaatggattttgatacatattgttccggacagactgaaaactcagtgcgggtgcaacttcggggagatatgccgttgcagtcaataacggacagaacatataccgttacagataacagtttacttatgagcggaacaacattcaaggaagcagggaaagatatgagtgtacagctactgcgtgccgccgtacgcatagatgtccgggtggctgaggataaaagggggacggttctcttgaaatcggctatgcttcgtaatgtttcaccggtaatacctgtatttaatgatccgcaggatatagctttcctgccgttgacttatgcaaatgaaaaaaatgcgtcagagcaattcagtatcataggcggtttgtatgccactgaggtgttgcgtactctccatactccctatctgctacaaacgcaggcggtgtgtctgctgttgcaatgtgaaaagtctccttataagggatggtatcgggtgaatattaatatcgataaaaatgatgtgcagtatttacgacgtaacaatgcttatacggtgattattaaagatgttttgagtcagggggccgatactcccgatgaggcatacggagcgggtagttttggtataaaaacggtcactatacctaccgattggaaagtccccgatgggatagtaactccaccggatgtagaagtgaattgaatgatttcataaaaataataagaacgatgataataagggagtgtaaaatagattgttttcagaagtcctgcattcttctgtgtgttgcgctcttctcctgttcgcagtatgactgcgttgttccgggtgacggaaagacaggagaaggagagcgcacttctttatgcataggcggagtttcaacaggacggttagaggtacttacgcgttcggctgctgagcttactacagtgaccgatgccatcggggtttttcagaaaaaagatatcgcgaatggttacgaggccattcataacagaaaatatacatatggaactccatactggaagacggatggggaagaactggtgttgatcgatggaccggcgaaactgacggcttactatccttataaagaagatcggacaagtagtgtggtgatgaacagtgaactctatgcggcttcaaaagagatctattattgtccttttgaggcttcgaatacaacaggtgccgtaacgctgaatttacgcagagcctattcgctcctgagatttaactttatcagaggagtaacagatgtggctctgaataaaggagagtataccgggaatggcgagatcagttcatttacattttctgcggctttacggatcaccggaacactggatctgtttacagggatcgttgaaggaggagtgcagggggtgatgttcagctataccgttccgataactatcggaaccgctgcagttcctgccgttttggattatatggtagtgcctgctgattttaccggggatctttcttttacactaataatagatggaaaggagatgaaaggtaagattagtgctgccgagctttgtggtacgaacaagaaaatggtggaagggacaaagtatgagatagatgtcattattcgtcccactgaagtagagataggaactgtggatgtggaagaatgggtagatgaggcagtcaaagactccggtaatccgtttgtgccgcaataaagagacagaaaggaataaatatgtttttaagaaagcagagaaagatgaaacacattctggcaaatatcgggatggcaatagtattgattgcctgtagcaacgaagggatggatccggtggataccggcggggaagacgagtatgttcctgtcagagtggaaaccgttgcggataatggcgttgaaacacgtgcggttgctttgtcaaatgccagtataggaatatttcgcacggcaccttacactgctacgtttccgcaacaatatgatgtacagtgtactcacgacggaaccggatggagtttggcagataaactatatgttggcggtacggacgcctctttgcatgtctattatccgtatggtaaggtcacttttaatggtgataatagtacggttactgctttgacagtgaaagataatacggcggataatgatttttgttatgccgatgctcctttagcggcagtcaataaccgcaatccggttgcttcctttttgctgaagcatgcttatgccggtgtgaagttcagcattgcttgtcattcgacttatccgttgaagtgcaagttaaccaagattgtgatgaaacccgcaacgagcggaaagaggttttatgtggaacgtagcatggatatcagtaaatccgctgcggatgcgggacagttgggagggagcacagcttccggttggacgctggatacatctgcacttgctatggggacaacagggatagcccaagggagtacggatgtaagtatcagcaaattgtttcctccacaggattttgaggacgatacccaactgatattgacaattgatggaagtgaatattcggtaacgattccgtacgagactttgaaagctctgaaagccgggtatttatctaccattttcctggaggtcaagggtacgggagtagatatttcgggagtgaaagtatatccatgggatacctctgttgtacccggtggtgataacgatgcgactttagattaataaatgattgtaacagaaaggatagtaatgaaaaccaagtctgatatgaaaccaattataatagccactttatcgctgattttactggcgggctgtggtaatgatgattttccggtagaagaacaaaaagttcctttagagattgcttctgcatttgtaacaggtgacgtgcagacacgtgccgtcacgccacaattacttacatcaggttcgatcggagtttttctggaaggcgaatccggaaccagttatgtaaaaaaagacaatatacagtatgactataactccggatggaaacccaacacggaaacaatctatttgggtggagagaatgccggtgtgtgtgcttataagaaaacaacgaaattagatttggcaactaaagaagctgtttctttgacttctcagatttttgacaccgaacttgatttggtatatgcaggtaagaaaacagtgaatggtacttctgccggtaagagcgttgagtttatcatgggacatgcttattcgcaaatcgaatttgtctttagccgggagaattatcctaatacatgcagagtaaccaaaatcgccataaagaacgcaagtataattgaaaacgctacgttgaacctgacaacggcagtttatacatcaactaagatcaatgctgctttcagttactggacaaatgcgacaaagcaggcggatggtattgtggttcctgaatcggggactgtgaaaagtaatgtgttgatgattccctgtacattggccaacagtagcggtacgggagtgacactggaactgacagtggacggtaaactgatgacagttccgattacgtatgccaagctgggtgcgttgaccaaaggcattattcatcagatcagcctgaaactgaaaggtactgcacttgaactgagtgtgaaagatactccgtgggataatcaaccggtagatggtgaatataatccggaaccataaaaaggaaggatgaatcatgaaacgaatttatatgcataatccggattctcacttggcaagacgcttgtggctgatgtggcttttaatagtaggctggagctcttgttcacaagtagaggttgcagactctgtagggggtgagaacggagagatacctcttgaaatcagggctacaaccggtgcagaggtcgacactcgtgctgttactgctgtagaaatgactgaagggacattaggaattttccgtttacccgagacggattatacggcattggaaaatattcgttataaccgtgttgcgggagaaagctggaagccggcttctactgtgatatatgtcggtgccacttacgccaggctatgtgcttatgctccctataactctgtagaatttaaaaatagtttgttgaaaacagaagccggcttgacaatgcagacctatgcggcggagaaagatatgcgttttgctgtcagtggaggggatgaggtctggaaaaagactcctactgcgaattttgagttgaagcgtgcttatgcccgtttggtattgtctgtggtacgggatgccacgtatccgaacacgtgtaagataacgaaagcaaaaatagaggcttctgccggaaatatattcacagccaatacggttgacatcagtaccggaaccgaaggaagcggaacacaaacacctcaatatattcacactgtgacgaccggtttaaaagacggatttgcaataggggttacagatgatacgagttttgattggctgctgccccaacaaactttttccggaggcgtagtcttgacacttacggtggatggtatggattattctgttacgattccggccgataaactgagcacatttgtaagaggcactaaatatactgtgtcattggttgtcaaaggtggaaagttaactttgatgagtgacaaaatcctgattgatagggattgggcagaggtgcagacaggaaccggaggcagtggcggtgattatgataccagttttaattagagtatgaagattatgaaacatttattatggatcctggtgggaggtattttattgagtagctgttctgatgaccgtgagatggatgacgggagatggaaagcatctgcgcttcgagtaccgctcgaggtatcttcggcagtcattaagcaggaggtagttacacgtttagctcccgatccggtagctttgacgaaaggggccatagggatttttctgtcgggtacagaagctggaagcggatataaagttattgacaatcgtaaatatgtttataacggcagtgattgggggcctccgacggctaatgatacaatttatttagtgggtaacgatgctgatgtctgtgcttactatccttataaagatgcgtatacggacaagacgatcattccattgcaatcacaggattatgtggaaactgaagatatctattatgcattgaatacaatgataaatggttttactcctgcgattacttttagtatggtgcatgcttattctttagtggagttaaagatcagccgtgagaactactttatgccttgtaaaattagtaaaataaccttggggaattccgctttaataaaaaaaggcactattaacattgccgttgacggaagtatacaggcctcggaaacagggaattatgatttgacaacagtaactgcagcttcacctcatacattgtctgttggcgaatcttatgtacgccgtgtactgatgattccggttccgcttaaaattgagcggacagatgcggaaggaggacaattcgggctgtctgtcagccttgtggtagatggacaacagatgctcgtggagatcccgtattccgaacttggagagttcaggcagggagagaagtatgttatcggattaaagatcaaaggaacagaaatcgtgcctactgtcaaagcattggaatgggaagatgataaggttgatggcgggaataaatatcctgttgaataaaatcatatttaaaactgagctactatgaaaggagtactatacataagttttttagtttgcatgttactggggtgcagcgatggtgatagcttaccggattggaaaaaagacaaaacagcccgtactgagttggaaattgcgtctgctgccattgtggaaggcaatccacagactcgtgccaatgtaccttttacgcccggaagttccattgctttgttttgccatgggcaggctgccgaaacgagttatacgcctgtgaataatagaaaatatacactaaatgccggtgagagtcaatggacagccgagtcggaggcgagtaccatttatttaggtagcgagaaggcggatgtgtgcgggtattatccctatacggaagaaacagtggatgagctttataaggaccgtactaaaattcctatggagacacaaaactatgacgttttaaaagaactgtattatgtggctaatcaggaagttgatgctaagaaatattttgtagatatgcattttaagcatgcttattcacgtttagtattgaatataggggtggaagatgcttatccggctatatgtagtattaattcagtggctttggcaaacgactccttgtttcgaaaagcggtgatagatattacgagtggtactgttggcatccatccggatgatacggagaaacaattcagaggtggatataacatcacaaaagaccttccttatgttttggacggtcctactaaaaaataccaggctgatctgcttatgattcctacaaaattattgcctgacccttttgaaccgactaaagggcttagcgtcatagtgaatgtaagcgggtttccggcaacggtgatcattccgataaacgatctctctgatttcgagagtggtaaaaaatacgttgtctctttgaaattgagagggattgcaattaaatcagtgaccgtaaccactactgactgggatgagaaaatactgaatgaaggtatagattacgaaccgcttccccaaccttaatgattatacaaaaatgaacagcatgattatgaaactcaatatgaatataaatacttctgtggctgccatatatgcaatgatgttattattggttgcctgttcgcaggaaagaactttatttccgacagaaaaaacggacagtgtgcctttaagcgtattcacttcattcaaggcggatgtgactacaagagccaccgctcaacccttgcctgaagggagcagtatcggagtttttttgatagcggatgctaactatgtgatccctcagagtaatgtgaaatacacttatcagcctgatgacgaatggacgtcagagacccctgtttgggtgggcggggcaagagccggtctgtgtgcttattatccatatggaaaagttactttttctgcagttacacagaccacattaaagacccaagcttacacggaggatgcggattggtggtatgccaaagacaatgtggctgtcacagtcaataatctgtcaccacagatcaattttttattggagaaaccttattctcagctttctttggagatgattcgtaacggaaggtatccgttgcagtgtaaaataaccaatgtacgtatagaattggacaacggagacccgatggttgacaccgggacgttcgatataaaagacgggagtctgcaaaacacaacaaatgttacttcttattcatatccaacctccggacctatgcatgacacgggattgggggtaggagaagcggcgagagataccacttgtaactatctgtttgttccgcaggctcttgcgtctggcttgaaactgactttgaccatcgatgaacgtgatttcagtgtgattgtgccacaggcggatcttgccggactggtagcaggaaagcgccacgtagtccggttggatatcagagggggaataccgattaatatagtggaggttaccacgaaagactggcaatcaataagctttgacggtggtgatgccactactattaaagatgaaacagagatcattattgatggtggtaaagtgggaacagaagattggacatcggatcctacacaaagtggatcaggggcactgtaatttaatattaaacgtatgaagacaaacctattattttttatttgcatcctatttgcattagtctcttgtgaacaagaagacaaggtatccggagaaaaggcactggctgtagtgtccgcttcttccgacgataggccctcaacacgcggaattataaacgatgatacatacgctttaggggtctttcggaccactgccggtacttatacgcctttattcaatgtgaagcatatttattcaggaggagagtggggatctgataatgtaatcaaggtagattatcggaatgcttctttttttgcctattatccttatcatacagcaaccggaaattatgccgggctggcaagtggcactaccttgaccctgcaagcacagttgttcaatgccggagaggatatttgctatggagcgggtgaagccttgaatggaggtccggttagtgtatacaatccgtttgttgagtttctgaatatgaaacatgcgtatgccagattgaggttgacactgactcgcggggaaaaatttgataagactaagaaatgtaatatacagaatattactttcaaatcgaataataccaatttttatctgacacgtagccttgatatcgcttccactgccggagctaccggaggaagcactgtggctgccggatatgttcataatcctaacgttaatattgccaccggtaaaagcgtgacatacgagtatatgtttcctccgcaaccacttgccggtagtaaattgactattcttgtcactgtcgacggggtaactcggagttgtgacatttcaacgttaggcagttctttggattcggggaaatattatggagtatcactgacatttacggatgtgggaatcatcctgtcatcggcagttgttactgtcaatgattttggcggacaaggaaatactcaggtagatacggaattataacataaacggagaataaagatgatacaactgaaagataaactaaaagtaaatggcggaacaagacggtacatggaaacggtttgtttgagcctgtcgctttctattttcgcaatggggtgcagccaggatagtgatacgttttatccatcggttccggatgaagaacaacccgctgtggatgaaagccggatgattccgatacagttgagtgtggacggggttgatcaattttacggaggggcagtgacgcgttcaggagaaactgttgctcgcctggtacagcctttggattctacttatgataccggatatgatgtggagacaacagtggaatcaattccattagagaatagtgtgtcgacccgtgccaacttgggcaatgtacagttccgtgtagtggcttacagaacaaatgcttcgtctgccgctaattatgcggggacagctgtttataagacaaatggttcgggagtcgcagctattgtagccaagacggctactcctgtcaatagtgccggacaatggatattggggccgggcacatatacttttgtgtgctattcttatggactgaatagtgcaccggcgatgctgtccggtaattggtctacaaccgtttcgcacaatcaggattttatgctttgccggaaagaaggagttgtagtagctcccgataataaaggagagtttacattgggaggaatcagctttacgcgtcagtgcgctttgctccaactagctgtcacggccaatgacttttctaataatacggttcaacaatgtgcagccactgtatccaacctgaatagtaacaacataacctggaatgccggtcaggcggccctttcaacaggcggtacggggggagctgtaaacttttcgtggagcagcttgaatgcggctacggttaatagtaatgtatataaggtgctgcctcagagcaaccgtacattaaccattaagctcacgactttgcgaattggtaatatacaatacaacaaccgagtgacggttaatgtctccgggcgtcaatttgcggcagggggtaattataagataactgttaagataaccggtaacggtattactgtgggaggagctacgtgggcgaaagggaatgtttacaggagtggggataatttttattttgagtcttcacaaagtggttatcacagtggtacacaaggtggatctttttttggctggaatacgctctcttccagtaataacacgtatggaggaagctctttttcttccaataatgatccttgctatcaggttgctccccgaggaacatggtgtactccgactgccaaccagttacagaacctgggaaatagtggatataggtctggaagtatgaatggtaagagcggaggattttttggcggtaataaggtttttctgcctgcaatgggaaacagaggtaaaaataatgtaaactattggcctggaacgggatattatagaagcagtacgggcgccagtaataagcgttgctattatctggagtttaatcagagttatgctgttaaaaacaactattattggtattgggatgcattcccgataagatgcgtcaaaagatgaaaattttgaaaatggtgaagtctaatatcgtaaaaaaagaataatgaataatctaaatgatctgatcaggatttggtgtttgctactgattttggtcgcctgcaaccaagatgacaatatggatggtatacccgatgatgccaccgtaccttgtgtcatcaatagcgtgagtgtaatcgaaccgcataaggtcaatactcgtgctacgataggagagggggattctatcggtgtctttttgacggatgatgtggcggcgaatggagctggtagtacccgaaaatattcggacaggaataactgtaaatataccaaggtgacaggaaagtggacgccgattgatgatgaaaacactgtgtcactggccgaaggagtttatgcaaacctttgggcaatctatccttatcatgccgataaggaaaacggattggattatacggatcggacagccatccctctaaagtcaagactgtattcggctgcaaaggatttgtgctatgggaagggaaccggggtaaccgatgagaccagttttgctcagcctgcaggaagtaaagttcctgtagatatttctttcttaaatatggatcatgcttatagctgggtcgtttttcggataaacaggcatttgtataccaaagatgccaagttgtctaaagtaaaagtgtctaatgtattgacatatacaacactggatattacaaacggaacttatgccggcaatgcatccaccccggagccgggaatcgctgagaaagtggacgaaacgattccggaactggaaactgattatgtagaggtgggctttcttatcgtaccttgcacattaggatcgatcggaaccattctgggagtagctgactgtggcatgaaagtagaccttacagtagacagtgacgtatatacattggggattccgcgttctaaattatctcaattggaagccgggaaaaaatacttgattgagatcaccgtacaaggagcgcatggaatcgtcattgctccggatggggtttctactattgactggcctgcgccaaccactgcttcgggagacttgataggtgaggctactatacatacaaattctgttttaaactgtttttggtcatgaaaattaatagtatgttttttattgccatgtgcggattgtgtatatcatgcggggcagagattacaacggacacttcatccgaaatattatccgacaggcagattcctataggaatatcgactgttgccgttcctgaatacggtgcggagactacacgtgggctgattgctaacgccacttatcaattgggactgtttcgtaccggtgacaaaggttaccctcctcagtatgatgcgccttatacgtatacagcaaccggatggacggcttctacagaagtgaaggtggatcatcgagaggtgagtttgtatgcttattatccttatcaatccgtttcctttgtagacaatacgacaacagccgtcctgaatgcgcaactttacagtgcggacaaagatatgtgctatgggaaggggctacctgtggggagtgcaagcatgattaataatgatgctccggaagtggagtttacagctatgaaacacgcttatgcccggctcaaactgacattgctgcgtggagcgaattatgataagagtaaggcatgtaatataaagaatattactttaaaatctaataataccgatttttatccgcaacgtcatttggatatcaccacggcagccggtgcaaccgaaggaactgccgtgacaacaggttatgtttataatccgaatgtgaatatagcgattggggagcaatcgagctatgacttcttgttgcctccgcagccacttgccggcaatacattaacagttcttgtgacggtggacggtgaagtgcgttttttgaatattacgggattcggcagttcgttggatgccggatcatactacaatgtatctctgacgattacagatatacagatggtacctacgaatgctttgacagtgaatgattacgggactcaagggaatactaattttgattataaatatgagatgcataattgacaggacgcaaacgggaatacttaaaagtatgattcgcctaatggcttgttcatgttctttgttcttgattttgcttgcagtgacagggtgtgacagggaggaagatgaaagatttccttcgggacatcatgatccgatagaaggagatggggagatggtatctatcaacgtaaaagtagatggggtagatgagtttttaggtggtgcggttacccgttccggagagattttgacaaagatagtgcagcctttggacagtacttatgattcgggctatgatgtagaaacgacaattgaatctttacttcccgttaatccggtacagacgcgtggcaatatggccaatatgcagtttcgggttgtagcctataaaaacaattccataacggctgctaattatgcgggtacagcggtttatagtaccaatgcttccggcattgcctcgattgtagcgaatacagccactcccgcaggtgtttccggacagtgggtgttaaggcccgggacgtatgcgtttgtcttttattcatacggaaccaattcagctccggccgctttgtccggtaattggtcgacaacagtgacgcataaccaggatttcatgttatgtcagaaggccggggtaaatgttacggccaatgcaagcgggcaatacctgttgagcggcattagtttttcgagacagtgtgcccaacttcagttgtgtgtagtggctaaagagtttaataataatacggttcagcagtgtgcggcaactatctcgggacttagcaacagccctgtgacctggaatgcgagccagacaactcttcctgtaacggggacaagcgggacattgaacgtggcatggaccaatccgaatgctaccacagtgaatagtaatgtgtataagatactccctcaaagtaaccgtacacttacaattaagtttactactttaaaaatcggtaatggacaaatgaataacgccattacggttagtgctacaaaccgtttattcagtgcagccggtaattataagataacggttagcattgtgccaaattatatctcagttgggggagctaaatgggccagaggaaatctttatcagagcggtagcaattattatttcgaagcggcacaacagaattatcatactggtgtcaatggaggaggctactttggttggaatactgctaatagtgcaaagggaaattacaatggtggaagttattccactgctaatgatccttgctataaagtagtgccaccgaatacatgggctactccgacaaaagcacaattggaaaatttaaagaatagtggttatgttcattcaaccaatccggaaggagggtggtttggaggaagtcaaggggtctttcttccggctcctggatataggaatgagaaagatcagatggtagcagtaggggatgatagtgattattggtcaactgagcctggtgtgtatttggctttcaatcgaggtctttgtggaatgtattcatatgatcgtcgtggaggtttgtgtatccgttgtgttaagcgataaagaacatacttgctaatttgaagttgttaaataatcaatcctaatataaaaaatatgagaggtttaataaataatagactactttttctttctataataatgttttttatctcttcatgtcggaaggaggaagaaggatctatcccaaccgatagacaagtgcctatcggggtcacggaagcttctttgagtacgagagtgtccacacgcggagtcattaataacgctacttataaattaggtcttttccgtacgaacgctaacggatatccacctcagtatgatgctccctatacttatagcgcaaccggttggaccgcattcacagaaatactggtggatcaccgtcccgtggggctgtatgcatattatccttatcagtctgtatcatttgtcgataacacgacgactgcgactttggttgcccaaacttatgacgtagctaaagatgtgtgttacggtaccgctgcggctgttgatggatcagcggtgataaataatgatcataaagcagtgcaatttcttaatatgaaacatgcgtatgcccggttgaaacttacatttgtccgagggacgaatgtgatgtcaggccgtaaatgtaaaattgaaaacatagtgttgaagaataattcaaccaatttttatcttcagcggcaagtcgatataactaccggcacgattaccggagggacccctgcggcggggggatatgtatacaatccgaatgtagaaattccatccgggaaccgggtttatgaatatttacttcctccgcaacctttgaccgatagtaaattgaccatttcggtaacggtagatggtgaagttcgtacggtcacggttactacgtttggcggtgcattgaatgcaggaggatactatcatgttacattgacaatcaatgatgtgcagattgttccgagtgcgggtgtaactgacattgggtatacgtcgggggatgatccgaagaatcccattcaaaataatactccaagtgtggtttaaaatgactataataagtgatgggagaggctcgctaagtgtgaggtttatacgggctatccacaccttttaataaattgattttagatagataagatgaaaagagaactgagcatggtcttgtgtctgctgttgcttccgggaatggcaggagcgaaggccggtgccgactcgccggaaaaaaaaacggtgtcggcagtgaataacaaacaaaaggtacgacagaaaataaccccggtaggtactcgaaagtccacctcggtacgccctttgtccgtatgcgaggtgaaggttgatctgcctacagacagcatgctgctctcgtgggtaggctttttgtcgccttcggctacggaggcaccgaaggttgaggaggtacggcagacggtgcgtggcagcatcgtgctggattacagtcgtgggcagaaaacgaagtatgatgcgcgtaactttgtagaagctgtttacaaacttttggctgtgacacgtccgcttaaagaaacaccgggtgtgagtctggaaggtattcgtttgacaggttatacggctccggacggtgactatcgggcaaacgaacgtctgggcctacaacgcgcactggcattgaaagattatatccggcgggagaaaagcttcggcacagtgccttttgaggtgaactggatagcggaggattggaaaggactgaccgatctgatagttgggtcggagatggcattcaaagagtctgtactcgacattatccgtacagtggatgtggtggacgggcgcgaacgaatgctgatggatttggcgggtgggactgcctatcactatttgtcgtcagctttcttcgggaagttgcgtcgcattgactacgaggtaagctacgtagacagaagtttggcggcgcagccatcgataggcatgacagaaggggtgtcggttgttacttcgggcaaaccggaagcattctcggtggcggacttctgccgcttggcagaagcacatgccgtaggttcgactgaattcaatgacttgatggacttggcgggacgtctttatccggacagtccggtggcgtgcatcaacgctgccggagtagccttgttgcgccgcgatacggagcgtgcccggagatatctgcaacgctttgccaccctgcctgaagccgggtgtaacatgggtattctttgcctgcttgaaggtgaccggggaaaggcggaagtttacctgagcctggcacaggcaggaggaagcgtgccggcaggaagggcactgcgcttcgtgcaaagtaagtaaaggctcaccacagaatacacagattcacacggagtcgttttttctctccgtgtggttgcatttagtaaagtatgaataaagaatctgtgaaaatctgtgtaatctgtggtgaaaagaaaaatggaaaacacaaactgacgaaagttatggatatagcggaaatagcaacaatggcgtttatcgcttcggggatgacatacaatgccgtgaagtattggcgggtgaaccgaaaagtgcatctcgctcgtgaatggccggtgaatctgattctgaagcaaatggattatttgtcggaagagtgccggagagcagtcttgttggtctttgaccgacgaggatatctggtgcgcaagtatcctgaggcggatgtactgaaacggagaaaaagatggcggctgcgttgtaccgtacaggaaggaatgctgaacttctgtgtgctgtttacaccccatgcgctctgcctgagcggaatacatcatcgtgatgatgtgtcccgcctgtttgccggtcatgccggcatctgtattgctgaaacgggactgcaggagattgttcatggcgcatcgttggagttgatagttgccggtacggaaacagacgaggaaaatgaaaaggtcgattctgccacactgaatgcattgcttccggcagaagtgattacggacgcaatggcaaaggatctcccggtggagttgaaggggtgtagcgaaccatggcatacgggaagcgtgcattacgcagaaggtgaaccggacaactggcttgccgtgcgccgtgagggggatcggctgttgatgcagtttcgtaccaacttttctgccgtggaacgggaggcagccattgagatagggaacgacgagggagtacatttgctcaaggtgcgtcagcaagtgatgggcattcatcccacgttgacggtcagtcgccggctctacgtcagtaccgggcggaagaacgaggcggtgacactaaccgttatccccgacaacgaacaggcatgctggtgcgtgaagagtgctaacgctaacgacggtggatgttggtattcggtctatccgcccgtaggcctgcaacagaaaggaagccagaacttgaaagtgcaccttgaagcgaaacctgccagtgtgcgttcgcgctcgctggtactgacactcgaaacggggacatatcctttcagccagacaactgatctgctattgatgcagggtgtctgctttgactattatatagaatatccgccagaggatccttgcgcacgccatagcggggtgatagagacaccaccggactatcgggaggaggagggagtgaggacgtatatcgtgtgtgtggacagtaatcagtcgtggcgtatcgtgagcgacaaggcggcggactgggtagaggtgagcgaacctgaactgttgcagggacattatgacggacggttcacggtgaaggtacattctaatgccggataccgggtgcgcggtggatttccggcggcacgtcatacggtgctctcgttggtgaatgatacgggcgtggtgcgtgacattcttgtttatcagggcggctacgtgcgtatccggggtaaatattggctggaccgtaatctggcggcagacggaaaattagcacaggtagctatcccgttgggattggaggtaggcactacactcaatcagggtacatattttcagtttggttgtcctaccgatcaatgggaggaaaattttacgccttgccgcggcagttggtacgatggcacggcagagagtcctgcacggattaatgagttggacccttcaccggagggatggcggctaccatcgcgtatcgaaatggaggcactgatgaacagtcccgccgctccgatggaacttcaacgggaggaggaccggacgaatatctgccttctgagtgacgacggggtaccggtatacctgcctctgtgcggacaccggagtcacatcaacggctgccggattgtgattccgcacggtcatcgttactggacgggaagcagtcaaagtccggtatacggttactcgctttgtgtggagcccagccggcagatgtacttgatgcacgatatgaagaagtatgggtttccggtgagaagcattttcaatgatgaacgatgaatgattaatgataaactttgaagagtatgatagaaataaggaagattgaagagatacggaggggcgtggatattccggagattacagcgatatatgatccgctgagcgggaagagagacggaacgatcacaccgatggcaccggtggtggtttcgggatctaatttcagtcgctatcaggaggattgcagattgtgcctggtggcggagaagaaaccggtggaggtaatcgaaatcaaacttgtgtatacatattcggataagaaggtgattgtggccatcccggaactaaagccgggggagtatcggcctgcagtgcggctgaaggagggcaaaggagaggtgtatgtgctgcctgcgctgtggatggtgaggggaagatggagaaaatgaaaaacgataaacataagcaaaatgaatataaagaagaatctggcggcgtttgtctcgacggtggtgctgatggcgctggtggtggtttgtcttggcgtggtgttggtgaaagcttgctcggagacggaagaacaggaagaggcgagaatagagtctgtaatcggatctgcggtgaaggactcagtgcatacgatacattacacccgaccggagataccgcagatgatgactgagccggcggatcgggcggcttattacgtgaagcattattgggacagctacctggtgggtgacacggcatgggtgaacagcgaggatacggagcagctgtatgtcgacttcatcgatgcgctgaagtatgctgcgccggaggcgagtttgggagcgttgcatgccatgatggtgaggatggaggccgatagcacagcgtaccggcgtttctgcttgctgggtgagaagtacctctatgagccgaactcgccgatgcgcaatgaagattattacattgctgtgctgaagcagatggtggggtccggacaattgaccgagttagagaaagcccgcccggcggaccgattgaaacaggcgcacaaaaaccgtccggggatgaaggcggcggactttgcatacgttaccccgaagggcaagggcgggcggatgattggattgaaggcggagtatacattactattcttctatgatccggactgttcgaactgtcaggagtatgagaagctcctcgcagagatgcccgcttttgtggaaatggtaaagcagggtacgctgtgcgtgctggctgtttatccggacgagaacgaggaagagtggctggttggggcatcgcacatgccgcaaggatggattgtgggctggaacaaggtgggggatattcgtaatcggcagctctatgatattcgtgccacaccgagcctttatctgctggatcatcggaagcgggtgattctgaaagatgcatcgatggaccagttggtcggttatctggcaacacgggacgaaaagaagaaataaggatattgaaaatttgtctgaccccggttacctcttcctataggggcatgtacaacagtggttgtcgtttattcttgttaggaactaattggaggaggtaccggggttttattcaccacagaggacacagtgttcacagagttagaattaaatttactccgtgttttctgtgatctctgtggtgaaatctttatttgaagccattattcgatattcatcgtcaactgtatccgtttccgctcgaagtcaatgctcagtactttcaccgtgacatgctgatggatggagaccacttcggtgggatcggtgatgaatcggtcggcaagctgggagagatggacaagcccgttttccttgatacctatgtccacgaaagcgccgaaattggtgatattgctgacgataccgggaagcaccatgccttcgcggaggtcattgatggtgcggacattccggtcgaattcaaaaacctgtattgtgtcacgcgggtcacgtcccggtttatcaagctcttggagaatatctttcagagtaggaagccctacggtgggggtgatatacttttctatttcgatacggttgcgcagggctttgtcggcaattaattgcggtacggtacacgatagatcctttgccatctgattgacaataccataactttcggggtgtaccgcggtgttgtccagtgggttctcgccaccggcgatgcgaagaaatcctgcacactgttcaaaggctttggctcccatccggggtactttcatcagctctttgcgagaagagaaagcgccgttggcggcacggtaggagacgatgttttgtgccagttgcggacccagtccggagatgtaagtgagcagatggctactggcggtattgaggttgacacctacctggttgacacagttctctacagtctggtcgagcgatttcttcagtttcgtctggtctacgtcgtgttggtactgacctacaccgatggacttgggatcgattttgaccagttccgccaacgggtccatcaggcggcgggcaatggatacagcgccgcggacggtgacatcataatcggggaactcgtcgcgggctatcttggaagcggagtagatggaagcaccctgctcgctgacaacaaatacctgtacggggcggtcgaactgctggtgggtgacaaaggcttctgtctcacggctggcagtcccattgccgatggcgatagcttctatcttgtaggcttctatcattttccggagtttggatgcggcttcggcttttttgtctaccgggggatgcgggtagatattttcgttgtgtaccagattaccttgcgcatcgaggcagaccactttgcagccggtacggaatccggggtcgatacccatgacacgcttttgtcccaagggtggagcaagaagcagttggcgcaggttttcggcgaagacacggatggcctcatcgtctgcccgctctttgctgataccggcaaactcggtttctatagaaggtttcagcaggcggcggtaggcatcctgcacggcttcggatacatggcgtccgcattcgttggtgctgcgtacgaactggcgatagagtcgttcgaggcattcatcgtcgtcaggggtgatactgaccttcagcaaaccttcggcctcggcacggcggatggcgagcaggcggtgtgaagtgcagcgtttcaggggagaagagaagtcgaaatagtcacggtatttggcagcttcttcatcttttccttttactactttggcagtgataacagcttgacgggcaaagaggttacgcacggcattgcgggcacgttcgtcttcgctaacttgctcggcaatgatgtcccgggcgcctttcagggcatcatcggcatctttgacatcgcctttcacgaaggcggaaacccgggcgttgaggttgttctcccgctgcatcattatcaacagggcgaggggctcgagccctttctgacgggcggcttccgcacgggtcttgcgtttaggcttgtagggcaggtagatatcttcaagggcagtggcatcccaggtcgcatcgatgcgttgctgcaattcgggtgtcagtttgccctgttcactgatggtgccgaaaatggtctctttacgcttggcgaggtcggagagtttatcgtactgcgttttgatagcttctatctgcacttcgtccaggccgcccgtgatttctttacgatagcggctgatgaaagggatagtggctccctcggccaatagcctgagggtattgctgatttgcttttccggcaggttgagcgctgccgaaatcattttgtgaaagatttccataaactatttttaggacattgagcgacaaatgtacgcaataatctactataaccatcaacttttagtatctttgcgggcataaaaaacggatacacacactctaaaacagatgaatatgccggtatcatttaaatatactctttttctgctcctgatagttattagctgttgccgtcccttgacgggatatgccgctaccggagagaaaccaatccttatgatctgttcgtacaatccgggagcgtatccaacttcggccaatgtttccgactttatggatgaatatgataggctggggggtaaaaggggagtggtcattgaaaatatgaactgtaaaagcttctccgattttcctcgttggaagggagtgatgaaggatattttaaataaatatcggggagatcaggaaccggcgctaattattctgttcggacaagaggcatgggcatcttatttgtctctgaacgactcggtaacgggagaggtacccgttatgtgcgcactgaccagccggaatgtggtgttactgccggatgatgaaaaagatctggtacactggatgccggagtcatccgatttttatgaagataacctgaaacggcaggttcgtggtggatttatgtacgattatgatatcgcgtcgaatatccgcatgatccgggctatttatccggacacaaagaatatcgcttttatatcggacaatacttatggaggcgtcactttgcaggcacatgtgcggagggagatgaaaaagtttcctgatataaatctgattttactggatggacgcgaacacactatttataccattgtggacgaacttcggaaactgcctaaacacacagttgtactgataggtacgtggagggtggataagaacgaaggttattttatgcggaatgccacgtactcgatgatggaagcagttccggacataccggcatttacagcaagttcgatcggtttgggctattgggctgtcggaggggtagttcctgctttccggacatttgggaaagaactggcaggggaaacggtcaaatttttggaaaaccccggagatacgacgctacaggtggagttggtaggcacggaagcacttctggatagtaaaaaagtgaaggagcagaagattgatgtggctgctttgccgatgaaagtgaaattggtcaatgaattgccttctttttatcagcaatatcggtatcagatttggggtggagtgggtgttctgtgccttttggttatgggattgctggtttctatctatttctatctgcggacaaagcggttgaaagacgatctggagcgttcgcaggcggatttgtatgaggcgaaggatcgggcggaagaatcgaatcggttgaaaagtgctttcctcgctaatatgagtcatgagatacggacaccactgaacgcgattgtgggcttttcggatgtactggcttcgggcggaagttcagaagaggatcagcggaattatttcagaattatccagtcgaactccgatttgttgttacggctgattaatgatatacttgacctttcgaggcttgaggcggacaaagtgacattgactccggaagactgtgacgtggttcaactgtgcaggcaggcgttgtcatcggtagagatgtcgcgtcgggaatcgggtaatcggtttgtttttgaaacccaaaccgaatcttttgttttacaggtggatatccagcgtttgcagcaggtacttatcaatctgctgacgaatgcagcgaagtttaccaaaaatggtacgattacattgcagtttgaggtggagaaggagaagaaccgggtgttgtttgcggtggcggataccggatgcggcattccgaaggagaaacagaaacaggtgttcgaacggtttgagaagctgaacgagtatgcacaaggtaccggattaggactctctatctgtaagctgacagtagataagtggggtggcagtatctggattgatcctgactatgaaagaggggcgaggtttgtagtttcgcatccgttgtaagaaaaagagactgtcacagggtcacacagagtttattctctatttaaatcctctcagtgagcctctgtgtgactctgtggtgaatcaaatttaaaacattattatgatgaaaagattgatttgtatttatgctttcttgctttgcctggtatgtgtattgccggcacaagagagagaggtgaaactcaagattgtgcagaccagcgatgtacatggtaattacttcccttataattttatcactcagcaagagtggggcggaagccttgcacgcgtgtatgcgttggtgcagaagaatcgggaagtttataaagagaaccttattttgctggataacggagatattctgcaaggacagccttcggcttactactataattatatagatacggtgacaccacatgtctgtgccgaaatgatgaactttatgggatacgatgccggaaacatgggaaatcatgatgtagaaacgggacgccctgtattcgaccgttggatcggtgagtgtaactttccggtgctgggggctaatattatcgaaacggctacgggcaagacccatcttcctccctatcaagtgttggaacgtgacggggtgaaaattgtgatattgggcatgattacgccggctattcccgcttggttgtcggagaacctgtggcaggggttgcgattcgacgatatggaggagacagcacggaagtggatgaaagtgatccgtgagaaggaaaaaccggatttggtgatcgggctgtttcatgcagggcaggatgcttttgtgatgtcgggtaagtataacgagaatgcatcgttgaatgtggcgaagaatgtgccgggattcgatatggtactgatggggcatgaccatgccaaggagtgcaaaaagatagtgaacgttgcgggtgactccgtgctggtgattgatccggcaagcaacgggatcgtagtgtcggacattgatgtgacactgaaattgaaagacggtagagtggtgagcaaacagatagacggggtattgacggatacaaaagaatatggtgtaagtgaagcctttatgagacattttgcagtgcaatatggtgcggtagagaagtttgtttcgaagaaaatcggtgtgtttacggaagacctgtctactcgtccagcctatttcggctcttcggcatttatcgactttatccattcgctgcaactcgacatctcgggggcagacatttcgtttgctgctccgctctcgtttgatgctgagataaagaaaggagatatccgcgtgagcgatatgttcaacctgtataaatatgaaaatatgctttatgtaatgaagctatcgggaaaagagattaaagattttctggaggaatcctattatatgtggacgaatcagatgaaatccccggaagatcacttattgtggttgaaagaaaaacgcagggcaggtgctgaggaccgggcctcattccagaatttcagttttaatttcgattcggctgcgggcattatctatacagtggatgtgactaaaccgaaaggagaaaaagtgactatcgtcagtatggcggatggctctccgttccggatggaccatatctataaagtagcactgaactcttaccgtggcaacggcggtggagaactactgacaaagggatcgggaattccacaagaaaagctgaaagagcgtatcatattctcaacggataaagatctccgtttttatctgatgcagtatatcgaaaagaaaggcacactgaatccccgtgcgttgaaccagtggaaatttattcccgaagagtgggtgaagcccgctgcagagagggattatgaatatctgtttggaactaaataatagaatatggctgaagaacttacatttatatcgggcagcaaagaggaacaatatctctctttgttgcctcaggtaaaggctctgatagagggggaagaggacctggttgccaatttggctaatgtagctgctgtcttgaaggaagctttcgattttttctgggtaggtttttatctggtgaagcaggaccggctggtactgggaccgtttcagggaccggtggcctgtacgcgcattcgaaaaggtaaaggagtttgcggcacggcctgggaggaagctaaaacccagttggttccggatgtggaagctttcccgggacatattgcttgcagctcgctttccagatcggaaattgtggttccactgataaaggaaggtagggtatggggagtgttggacatagacagtgatctcctgaatttctttgatgaaaccgaccggaaatatctggaagaaatgtgcagatacttatgaaaataataactatctttgccgacttaaaaataagagtgcaataggtgggatacatcaaaagagttctattatcgtttctgttgttgacgctgttcgtgacgtaccaggtgagcattacgatgtttacccatgtgcattacgtaaacggtgtaatgattgcgcactctcacccctataaaggtactcactcacattctacatctaatattgttgttattgcccattttgccacattccattcgctggaagcccatgtgcaatatgattttacacccgaacggccggtgctgtttacggtagagatacctgagagtataccggtgacaactgaaacacatttacgggtaatttctttgcgtgcccctccggccgaacaggcttaaactaaatttagggggagagcccctttccgtttcttttactcttttatatatcatagctaataacaaacaatgaaaaattatatagttatgcttgtgcttgcgtgtgtaagcatgagtttgtatgcagtcaatccgattaaagaaggtaatatgattgccggacacgttattgtgaaaggcactgaagaaagcattccgttcgcaacggtaatgatattggggaccaaccgtggtgcggtatccaatgaagaagggcagtttgaatttcgtaagttggctgccgggaaatatacactccgtgtacaggtaatggggtataaaacacaggaaaaaacaatcacggtcagtgcagaggccacatcggtggttcatttccagatggaagaagagagttttatgacagatgaagtggttgtctcggccaaccggaatgaggtgagccggaaggcggcgccggtggtggtgaacgtgatgagcgccaagctttttgaaacggtgaattctaccgacctggcgaagtcgcttaattttcaatcagggctgcgggtagagaacaattgtcagaactgcggttttccgcaagtacgtatcaatggattggaaggtccttactcgcaaattctgattaatagccgtcctatcatcagcgcattgtcgggagtgtatgggctggaacagattccggtaaatatgatcgaacgtgtggaagtggtgcgcggaggtggatcggctctgtttggggccaatgctgtgggaggtacaatcaatattattacaaaagatccgataaacaattcttttcaggtggcaagcacgatgtctaatatgaatggtaagtcgtgggagcaatatatgggaggaaacgtttctctggttgcgaaagataattcgtacggtatcgctttgtatgagacataccgaaatcgtaatccttatgatgcggacggggatggtttttcggaactgggcaaattgaatatgaatactttcgggatgcgtgcatactatcgtcccaactatttcagccgcatcaatgtggagtatcacacaacaaatgaatttcgccggggtggcaataaattcaatttacaacctcacgaatcggatattaccgaacaaacaaaacatattatcaatagcggaggattaagttatgaccgttattggggagagaagcataagatgtctgtatatggatctatccagcatacggatcgcaacagctattacggtgctcaacaggatatgaatgcgtatggtaaaacaaacgatctgacttgggtagtgggaggtatgtatgtgggaaatatggaccgttgtctttttgcccctgctacatttacaggtggtgtagagtatcagaataactctctgcacgatgtgatgaccgggtatcatcgtgacatgcagcaggatgtccgtattgccggaggatttgtacagaacgaatggcgcttgaaccgctggaccatgctcgtgggagcacgtctggacaagcataacctgatcgatcatccgatctttagcccgcgtgtgaattttctatataagccgagcgataatttgcaggcacgtctgacatactctaccggcttccgagccccgcaggcttacgatgaagacctgcatgtgacagctgtgggaggtgaaggggtgcagatccgactggctgaggggttacgtgaagaacgttccaacagctttagtggttcggtggattggtcgttcccaatgggacactggcagtctaatattcttctggaaggtttttatactgatctgcatcatgtatttgtgctcgaggatatcggtctggacgagaatggagataagataaaggagcgccggaatggtagcggagcgaaagtatatggtgtcaatctggatgcgaaggtagctcacgggcgtgaggcacagttgcaattgggatttacagtgcaacgcagcagatacaaccgggcagagatatggaccagtgaaggggaagaggaacagacaacgaaacggatgcctcgtacaccggattattacggttatttcactttcacgtcggcaccgttgaagagctttgacttttcactttccggtacttataccggtaagatgattgtgccgcatatggcgggatacatcgagaagtcgcgtatggagcacaccccgcagtttgtggaccttaatctgaaactgaactatacttttgtgctgaaagatcatatcaagatgcaggtgaacggtggagtacaaaatatattcaatagtttccaaaaggacttggataaaggagagttccgggatgcaggttacttttacggaccgactcagccgcggacttattttgtgggaataaagataatgaattaaatccagggttcaccacagagcctcacagagttttatcgagaagaaataggaaaaactctgtggggctctgtctattttatggtgaactcgtttttacttatcaggtattcgtcggaatgtttttattcatatctttgtgatgttacatttgaattaaaaaaaagaagaccatgaataaagaagtagatctttcagtatcctgccttggaaaggtgaaagggctgaaatatgacgttatcatcttaccgtggggagctacggaaccccataatctgcatttaccgtatcttaccgattgtattcttcctcacgatattgccgtagaggcagccgaaatggcacttgcacgttcgggagtacgttgtatggtgatgccgcccgtaccttttggagcgcataatccgggacaacgtgaattgccgttttgtattcatacccgttatgctactcaacaggctattctggaagatatcgtatcttctctttatgtgcagggattccggaaactggtcatcctgtgtggacacggaggaaacaattttaaggggatgattcgtgatcttgcctttgaatatcccgattttctgattgctgccgcaaactggtttgaagtggtttctcccaaagggtattttgaagcggaggttgacgatcatgctggagagtcggaaactgctgtgatgatgcattatcatccggaattggtgaatctggctgaagccggtgacggaaagtcgaaaccgtttgccatcgcttcgttgaatgagaaagtagcctgggtgccccgccattgggataaagcgacagcagacagtggagtgggagatcccagaaaagctactgctgaaaaaggtgaacgctatgtgaaaccgatcgtggagaagctcgccagacttttcgaagagatggtgaaacacgacctttatgaatgatggggaaggtatacttataaaaaacaggcagtggcggatttccgacactgcctgtttttttaattgttacctaaaaactaatctttattcctataaaaaacaacctatttattaactgctgcaaaaatacagcatgtaattggattacgttttgatataaatcaaaaaatattttttacagtactcccgaacgtacacgactgagtgtttccggggtcatcagcaagtaggaagcgatgtgtgataacggtgcccgcttgataatctccggatggtgatgtaaaagcaggttataacgttcacgtgccgtttcaaaacgccatgaatcagcttttatttgtgatacaatgagtgaatattccagcactctgcgatagaaagcattgatctctttggactgttccagtaacttttgcaggatgtcgtagggaagcatgtatatcactgccggttccaacgcttcggccatcaagtgggtgggttcttgtttcaataaactttcgatgcacatcagaatacatccttcgtatgagaagtgttcggtgacatctttcccgttcttataatagaattgccgtaacattccttttccgacgaaaaccatgtgacggcttatttgtccttcgttcaacaacatttcacccttttccagttctttacgtatcaagacctgtgccagtagttcccgtccctctttgttcatctccggatatctggagtttacaacagcatccactgtctctttcaggttttccatcatgtatatattgataagttattatagattgcggagacaaaaatacgaaaatcagttgatataaatcaatttttcaaagtaaaaagattccttctactccaatgactgccctggagagcgagagtatgaaaaaaaagttctctcctttaacatttgaaacttagctggttaacttatttcgcataaaatccgtgaaaaaaatgttgtagaaagatttgcgtagttcaaaagttccctctatctttgcatcgcatttgagaggaaatgcggttaaaaaggaagtttgggtgagtggctgaaaccaccagtttgctaaactgacgtacgggtaaccgtaccgggggttcgaatcccccagcttccgcaccaaatctcaactttaagatgacaagggaagagccgagtttattgcttggctctttttgaatctaattttcagtcggtgggttcgtctaacggttaggacacatgcctctcacgcatgtaatacgagttcgattctcgtacccactacaaattataatcagccttttacgataacgtagaaggcttttttattgcttttgggttatgaatgataaatatgaagagaggcttggtactgaccgtatgttgccgcttgtattcaggatggcacttcctgcagtaattgcacaaattgtaaatctactctacaatattgtagaccgagtctatatcggacacattcccggaattggtacacaggcgcttgctggtatcggtgtggcaggttctctaattattttgatttccgccttctctgctattgtggcggggggaggtgcaccccttgcagccatagctttagggcagggcaatcgctcacatgcaggaaaaatattggggaatggttttgtgctattattactttttacgctcctgacatctgccttatcttatctttttatggagccggtacttttgtttacaggtgcgtccaatcagactctcggatatgctacggattatctttcgatctacttgatcggtactctgtttgtagaggtttctgtagggttgaatacctttattaatactcagggccgtcccggtatcgctatgttgtcgattgttatcggagcgctactcaatatcctactcgatcctctgtttatttttgtttttggatggggagtgaaaggggcggcacttgctactattatttcgcaagcttgcagtgctacttgggtattggtttttctgacatccggccgtgcttctttgcgacttgaatcccgatatatgaaattggataggaaagtagtgggtgctatactggcactgggcgcttcaccgtttattatggcgagtaccgaaagtctggttggctttgtattgaacgggtctctgaaaacatttggtgatatctacgtgagcgcattgacgatcatgcagagtgctatgctttttgtcagcgttccgctttccggatttgcattgggatttgtacctattgtgagctataattacgggcatgggaaccgggagagggttaaagaatgctttaagatagtgatgacctttatgtttttgttcaattttattttgattctgctgatgatcctgtttccgtctgtcattgcttcagcctttacgtccgatgaaaaattgatagaaaccgtagtgcgggtgatgcctgtatttctggcaggaatgacgattttcggattgcagcgggcatgccagaatatgtttgtcgcactggggcaggcaaaagtttccattttcatagcattgctccgtaaggtgattttgttggttccgttggctctaatacttccgcatctgatgggcgtggtaggagtttatgctgccgaaggcatatcggatgctacggcagctatttgttgcacagccatcttcgctgttcagttcccgaagattatgaataaattggcgatgcgttgattaccgagaggattgaggtgccgctttttgtttcttcttagaggctatataccataaatagatagccaatatgacaaaaacagccagaatcgtgatcatctctgttggatgccctaacggatcaacccatatttcgctgaagaaatccattcgtcccaatatttccaccggtgtccagaatacgattaccgtggctattgccatgcgaatgtttgctccccaagaggcaagtcgtaactgccggcgaaacatgaacactgaaccgaccaggcaacccatacctatcaacattgtcaccggatgatggtccccaaggaagttactgtcgtaacagaacatcagtaataggtagcaactccataacatcatgttaagttccatgaaggtaacgatagatgtatgacgggtcatggggcgtgccacgatttcacttttcttacttcggaacaatgccgtctgacaccaattgataaagttacagcctgtttttacactaaatagatagagcaccatgaacatagcccagaatccgaatgaggtcggcataatcagatattctggtcgtgttactacttctccatttagcatttcgggctgtactccgtatcggttggcatagtacataaataaaaactctacccagcctgtccaaaaaagcaggccaccgaacagtccccaaagcgtttgtttcgtgtcgtttcgtgcgaagacaccgatgataaccataagcaatcctactcctcccatggcaaatgccgtataatggagtgcagtaggaatgatcagatgctccatcataatcattagggcatgtcccaaaggcatggtaaatagaactaaaagaaaagaagcaattgttttccaccaatatctggtttgatttttcattgttgtttgtctcattttgggttatacttaatttaattcatcacaatagtaactgatttgtccgccactgtcgcctatctccgaatcggcattataccaactgatgatttgtatcttgaaatatcgtttaccatcggcggtacgtatcacataggtgtgataagagggcgtgtaaaccggagggggaccggcgaaactcatggcttcagccaatatcggattggcgctggtcaatgttttagccggaccggtattggggtcgaaccacggattctcattaaaatccagcccatgctctatcagatatttgttccagtcgttttgcgacattgtgacgtatacttcagtatcattgtctaccgtccatttcaaatcagcgggtagttgcgaaacagttttccatttgtcatagcttccatatcccagatcagcggcagcaccctgaccgatgccactggtaccactgttggtgcgcaggcgatatccgcagaatgcgagatcccaatctgtgcgctctttctgttctccttcagtaatatcctgattaggtgaaagggtattaaaccgctctccggtacgtaagttgaaataaatccaatcgttcgtaacaccggtggaataaccgcatgtgcggggcagtgtcttaccggtaaacggttcggcatcatattttacacacgaagttattataatgcagcagaatgacaagcataaagctttaaaaacattcatttctctcatttctttttctttaatgcatttattacgtcgtctatcataaactcaatctgtacgtgtccgcgggcaccgggggtggcgggtacattgaacatggtcactcccgaacccaatgttttgggcttatagtttaaaaggttgtcgatgcccagtgtcacttttactttgttgtagaaggtttgtgaaacggccagattacacagcacatatgccggaagatcgcaacggaagtaggcatccttgctggtattctcctcctcaatccatacacgatcctgcacatcgaatttcttgttacccataaatgatgcgctgaatatggcacccaaccgatagtttttgcgattgtacttatagtccaaactggctgtagctgcgtgaggagaggtggtgttaacctgtacacctttaagtttgctcacattgacaaaactgtaggtggcattcagcgtcaggaagtcaaacatgcgccaacgtcccagtgcctccaggcccagtaagcgctgtttgctgagattagtgtattcaaaattgtattgcatgtcatagattctccagactccttctattttatctttaaagtagtttccgtaaaccgtaccggacaagaatagccggtcgttggtgtattcggctccaactgacatgtagttgtttttctccggttgcaggtattcgttgccttttatctgaaacatgcccagatgatcccagttgaagaaaagctctttgatactgggtgaacggtaacccattgaatagttggcacggaaactccattggtcgttgggtgaaaacttggctgcgattttgggcattcccatgaatccgaaagcatgggaaaagttagtacgcaacccggcggaaatcatccattgtttagacacttcccattcgtcctgcagaaaatattccgtttctttcagtgaccgtgtagtcattttgcgattcacaaaacggtcgcttgtcaggtcatccgaaatatgttccactccaaagatcagatggtgggctttaaagtaattgctggtgatggtcagtcgtggttgcaagattcggctttcatataccttctgccgttcattccggcgttcgtgtcgtttaaagcggtcataaaaatcgctatgtaaacttccggttacagaaaaccagtccttcacatggtaagtggctttgattcctcccgtccagtcacgtgcctggctaaaagtcagatcttgtatcaggtcgtatgtattcatgaagaatgcgctgccatagagcaaaaccgataaatctttgttcggatcgtaataaaccttttgtgaagctgaaatatgttcggttccttcgattcccataggcggacgcgctgtagcactggttacaatgatatcgtgaggtaggaagggattggcttcctgtgtatatatcttcttgtcattttccgcctgataaagatagaaagcatcactttcgctgtaccatacatctgtttgcgaggtaaatgctccctgcttaaaacctgcggagacccaactttgcagatttgggcggtcagcattcttttcgaacatgtagaggaagtcactctttgatggatttttataattacgttcgttcatttgcccgtaacgcactccggcatcgatactaagaggtttgttcgtctttttagttatcagattgataacggctcctgccgcacgcgaaccatacagagtactactggcacctttcacaatttcgatgcggtctatggcatgcagattgaaacgttcgtaatccaggtttccggccatgtctccggtcagtcgttctccatccatcaggaataacacatggcgtgcatccagtccctgcatgcttatttcattgccaaagcctactttctgtatgttcaatcccggtgtttcctgttgcagagcctgctgcaagtttccatatccggcgtctaccagtgcttttcctcccaacacctgcgtggtcaccggagaaagtttgatgggacgtgccgtgcgtgaacccgttatcactacttcgttcagtcccattacatcttccgtcatgtgaagggtcaggtttcgggttgcttgtgttatttttcctttcaggggtatgtagcctacggaagtgatgtggtaatggtatgtaccgggacgagggagcttcaagatggcattgccattcaggtcagtgatggcatacaatgtcttttccggattatcattttctgcaaatgctatatttgccgctattatcggttgctcggtctttgcttccagtattgtgagttgcacttttgtttgggccatagaggcggtacatataaacagaagcaggcatgtgatcgttacaaattctctttttttcatttttctaaaagggtgtgtgattcacagtttatgataacccatgtttcttcttatactcttccaagtctttttcaaattgtgcgaactccttttcatagttgttgatgcgcgtcttgtctattgtttgcaggaaacactccgagcgaacgttcatcatgttgtagtccacaataaaattaatctggtgagtgtcggtattataatagccttttacactacttcctttagcattggccggagtgccatctttttcttctccccaagtagagccgtcctcaccatagaatttgatccagcctgcacccggatattcgtctttttcccatgtgttgagttgcatggtttgtacgtcacatttaaagttgatgatcatccccattttgcctacggtgaaattaagaagagacacactgaaagtatttgtatctgtattgctccagtcaaacttaaatttggtggggcatcctttttcaagcaatgttttattgacaccattcagggtggcatgagtattcaatacgatttctccggtcagaaaatcttttgctttctttacgagctcttccgaagctcctcctttggttatttcttcatcggatgaacaggatgccaaaaataaacagatactgcaaagaatgatataggataattttattgttttcatcttgaaaaatagttttttatggtttatataatgaatattcggttattgtttttttatatgaatgaaaggttgttttcttgtcacaacaacaagaaaacaacctatggtacattagttcattttgtggagaatattataaaaaactttatgctccactaaaattcactttgttccttcaaatgtaacaattgcttcgaatagtgaacctgaatattgagtatttacggtaactgtaaacttcaggtagtttccggtaatttctccttccactaaagcatcataggatagggggagtataccgatcttgagttttacggcactttcacaggtctggctgaagtttcctccggatgcagggacagtgatgtccatcgcgtcgaccgtaatcgatcccggcatcgaacctattttgaatgaatcaatatgaatattgaccgttccgtctccattatcggttacattggcaacctttccataaaccggatttttttctccattcatgtaaactcggatcaggttaccctgatagttaccttccagactttcggcaacagttgctactgaatatacgtcacttgctgcacttgcagaaacattacttgaaatagctgtcattccgaataaagctattccccagataaaaacttttttcaacataagattggttttaaaattaaaataaaaaataacacatatatatatgcttgttagctgttaaatcttctttgtccaacggaaagcaccataatcactgtagtctctgtatccggagtcatttagattttttttgtaagtactaaggaatgttttacatgcctcttgcttaaattcattttctgaaataaggattgtggctttctgtgcgtcagccagtggctttagtgtttcgtacgctgcactatagacatactggaaattgggataagtgatggtacaattctcgagttgcaataatatgacagcctgaaaaccgcggagaaagcttaaatccatttttttcaatgaaggcaggctggccagttctaattgagagacaagccctttgctctgttccggaaatttgatttcttttaaattctcacaatcgaatacatgtagtacattagagattgttttatcaaagtcggttgcttcctgattggtgacaagtgtttttgatagatccagttctgtcaaatatttgttgttgcttgaaccgaaacttgccaacttggcagattgtgaaagatcaatgccctcaggggtatctgcattcagaatgaaaagggctttaaggttgtcacgaggcataagataggcaaccgaacaatgattcatgcactcaacttgcacatagaatggtttgtagaaaggattattgataaaatattctaatccttcaattgaatgtatattttcattatccgcataccaggcatctatgttaatgccgctgccttgttcggtcaggggcattggcttactaatgtcaatctggtttccatcttttgtaaacaggcttgcaaacttcgatttcagataagtgcggaagtattcatcgggaatatcacgcaaggtggtataggcttgcaggattccgtttgcattttgcatctgcatgtcggtggctgcactggccgcatggaatggaaccagatcctctatattgtatttggccgtttccggtaaataaaatttagtgagtggatgtaagacagtagtgctcatttcatcatttaccatttttacatctaccaaacctttaaaatcatatattttattacctgataaatcaatcgcagtaatgtttttgggcaatgcggagaagtcgaaaacggggccatactcattgttcgatagattaatttcagcaaggttaggcaatacttccagtcccgatagattagcaatttgggtacccgatagatcaagcgaagttgtactttttactttatcatcctgtaccagtttgccttctgcattaaaggtatatcctttttgttgcaagacagttcttagttcagtatttgtcacttccactccattccaatcaatgttgttatcgttagtacatgaagtgaaacatataccggaaactgctataaacgtgctaatatacattcgaattttgttcattgtttaatgatgggttttttgataattaatatttgttttaatccggttacaaagttatatgcggtttaaaatatgtacaatacccatttatgggtattctgctgttgaagtttaatagtaaactttttaatataaatatattttatcggttgttgtagtttgtattttataagatgactttttatataagatatttatgttaaaaagaatcgtgctattactgcttgtgtagaggacggttaaagcggtatttcatcgagattataaaataacttcctatttgttgggtgtggtgttcggaaaaaccactcgatgtcgtacttcggctgtagtttttcttttgattcagcatgtctgcccaatagactgataattcggcctgcttttttttcaggaagcgccaggtgatacctgtactccatactatctggtcgtcttctcccttccggatatttgtaccattacgaaaagtataggtcgcgtcgttttttaattgtatgttgccgggtaaatcggcataggcattgaatcccagagaatagttacgggtgtacgtatttgtctgccgtaatgaattggaagagtgttgaaagcgccagttcccattcaggtcgatacttccccatttagggaagtatcccagtcgtaaatttgcgttcagtccggtgttatgggtagtactgtggtctggttgttcactttccccttcattgatgagaccgacattttggataaaagatcctcctccgacggccgaaatattaaaactacggatgcgtttctggtaacgtagtgttccatggatgttccagttaccatttatgtttaccggataactctctcgccctcccgtttgccggttataggtaatggtacgggtctggctgtttatttcgttttgccagttcaatgtagcgaatataccttttcggatgttttgtgcttccaaacggactgattggctatatgagggcttcaggtcaggattgccgcgtgtgatatttagcggatcgctattgtcggtcagtgaaagcaagtcgggtagggaaggttgtcgggtatctccccgatagttcaagcgtatcagacttttcccttttttccacagaatggtgaatgtcggtcggaatccgactgaatacatggtagtatcagcttgtctcagccctgtcttctgatccagactgcgttgctcaggctgaatcgatagtccggtaacaatgttccatacccgggtggagtagtttatatggaaagagacttcgtgtccgagtgtgcgactgtggcttcggttactaaggctgtcggtatacccggtttcatactgcggaggcagatatccgggaggatctgttgtttcatccgtcacaccggataggttataagtgttacggtcgctctgctgtttgctatagttcaaattgtaagagagctgcatttgaactttttttgtaaaagggtgagtgaatatcagtccgatattctgattccggtttccgttagggcttcgctgatattgattccgatagagaaccgagtcattccctaagctattttccaatcggtaataggtggttgacgaaatagtgaaactttcatttttacctttgctgtcactatattgtgccatcaggctgaggctgcttccttttcggtttatttggcgcgtgatgttggcattgaaagtatattggaggcgcttgtctgtagataatgaattcattgttatatcgttgagtcgcatatcatcggggatattaccgatattgccgaaagggtctgacgtttcgagattgggattctcgtcgaatgcggcttgccggttgttattggtgttgttccctctgcctgagttcagattgccggagaagctcacaaaggtcttttcgtttatttgccaacgcagggcaagcatagagtttatggtatggtttcggtttgtactttcaccggcagaatattggtatttatttcccgtactcaggtattgttcatagtatccggccgatttattaccgttattgttatgattataagtcgtattaccattaatggtcaaatttttgccgaatctttttacaaagttaagtgctatgttatcctgtatattgtccttgtaactggttgtcatgttacggttacccgaacggacgatcagtgaaaggttctcaccgccttttttaaagtagttacctaataattcaaggtccttcttattatagttgcccagtccggctttacccgatgccagcaaagtgctgttgaattcttttttggtttgcaggtctaagacataattctcttttccgctactgactcctgtcgttttttccagatcactttttttatcgtatacctttattttattgatcagttctaccggtaaattttccaatgccagactgttatttccggaaaaaaaggcttcaccgttaacgttgatttcagtaatgggcaggccattatagaccagagttttatctttgctgttgtattccaacccgggaatacgttttacgagatcttccagataactactttccggtgttttataagcagacgcattgattatggtagtatcgcctatctgctctatttcacgtacttgtgcggtaactgttacttcatccagttcgataccctctttcagtacaatgttttccagatgaatgtcaggaacattttctgttaacttatggaatactggttgcattcctgtataagaaactttcaataaatagcgtttacctttgtacgcaggataccggaggtcaaacttcccatttgcgttgcttgtcgtgcctttaacaagcgtagaatctttttcgttgatgacgagaacgctggcgtaaggtaaggactctttttcttttgcgtctgctgccatgctccatatttgtccgctgactctttggggctgttgggcatatagcttaatagccattccggaaattaaaattaataagatacaggttttacgcacgtccatttcgtatgtttagtatgaatggttgcaaaattagcgagtttcaggtttgcgttcaataccttttattaggtataataatcagatttatgagtcatagtcctcaatgtatgtaaccggaattatatataaaggatgggagtgcagattatcggatataaaaaaaggctactctcacgagcaaccaatctttgttaaccttaaatctaatactatgaaaaacacattgcaaatgtacggatttggattatatctgcaaattattcggatataaatctccgttttgtaacgttatttagcgaattgtcgttttctgttaacatttgatatgtcctttttagaactttcggtcttcttactcctgtttccctcttttaattaggcgattccctccgaagatgtaggttttttctttttcctgagatcatttgtttccctacttttgttcacatcaaactgatataactaaaaaactatacgatatgaaaactttagctttcaaatatttaaaattgtttctgctggcagtggcaatggtaaatcttacttcatgtgagatagagatagatgacttttatgacgatgataacattggcggttcctattataacaagtccctcgatctttgcagtcgtacctgggcagatacgttttatgatgctgacggaaactattgttatcaggagttgaatttttatctggaccgtcatggtgaagattatatccgtgtggaatatcccaatggacgttattccgaatcggtgtactcttttacctggaattgggaagaccgttctcaatattctctccggatggtctatggtcccggtgatgtttcctatctggatgatgtctggatcagggggaatgtactgagcggatacttggacggacatgataattatgttgactttacaggagtgagataacccgaacctttattgaaataattgtaggcggattgatatattcttgatatatgtcaatccgctttttcagtgtttttaaatacctttgcagcccgaaaaggattaaggtaaaatgacacacagaattcaacaggagagcataaagaggcgcttggcaaaactggccgctccgatttttattgaaacattactgataatgatgctgggagcggtcgacaccattatgctgagccgccattctgataacagtgtagctgcggtcggagttgtcaatcagattatcatgctgactttcctggtgtttgaagtgatcaatttgggtacgtccgtgctctgttcgcagtatcttggtgcgaggctcgaaaagaaagtggtacaggtggtaggtgtgtcgttacttgttaatttattggttggagggattatcagtgtgcttctgtttacgatggcccgcaccattctgcaatggatggggttgggacccgaactgatggctgacggtatggattatatgcgtatcgtgggtgctttcgccttttttcaggccatttctcttacactttcagcttctttacgcagtgccaataaggctatatatccgatgttggtaacagtggtaatcaatattcttaatatcatcggtaactattcgctgatttttggtaagttcggttttcccgaactcggggtagaaggggctgcaatctctactgctttcagcaggggagtgtctatggttattctgtttattattctgttccgcaaacatatccatcgtttccctttggcttatttccggcctttcccttttgtagagctgaaaaatttgatgcgggttggtctgccctctgcaggtgagcaactttcatacagttcatcgcaggtagtcattacttttttcattaacatgcttggagttgaagcgttggctacccgcacctattgtgtcaatatcattatgtttgtctatttattcagtatatccatggcacagggaggtgctatctgtatcggacatctgataggggagaagaaaccccatgcagcatttctgcttgggaaatatgtgatgaagaagtcggtaatgattactttgattctttcatgtattattgcggcttcaggccacactctattgagttggctgacttccaatcccgaaattatccgtatgggagtgattgtattgctgattgatgtggtacttgaaataggccgtcccattaatatttttgcgacgaatgccctgcgtgcagcgggtgatgtgaattatcctttttatgtcgggttgattgtgatgtggagtgttgctgtcggtgtcggttatttatttggaatttactgggcctggggcatttgcggtatgtgggttgcttttgctctcgacgagaacattcgaggaattatttttgtccgtcgctggtatgggatgaagtgggtgaataaaagctttgtgaggtcgtaaatagttgctatctttgcggacgctaatgtatccttatgcgtttcacggatacattggcttatggatacattggtaaattattcacatggagtggttatatagtctctttatcgaacattctgctttgcaggcagttgtcgttctttccctgatttccgccattgggcttggattgggcaaaattcatgtttgtggcatttcacttggcgttacttttgtcttttttgccggaattctggccggacatttcggattgtccatagatccgcagatgctgaactacgccgagagtttcggacttattatttttgtatatgccttggggttacaggttggtccaggattctttagttcattccgtaagggaggagttaccctcaatatgcttgctattgccgtggtgattctgggcactcttcttacggttgtttgcagttataccacagaagtttcattgcccaatatggttggtatcctgtgcggtgccacgaccaataccccggctttgggtgcagcccagcagacactgaaacagatggggcttgaaagcagtacacctgctctgggatgtgcagtggcctatcctcttggagtgatcggagtcattctggctgttctgttgatccgtaaactgttagtgcgtcgtgaagaccttgaagtgaaggagaaagatgatgccaacaaaacctatattgccgctttccaggtacacaaccccgctatttttgataaaagcattaaagatatcgctcacatgagctatcccaaatttgttatctcccgcttgtggagagacggcaatgtcagtattcccacatccgaaaagatcataaaagagggtgaccgcctgttggttgttacttccgaaaaagatgcgttagcgcttaccgtgttgtttggcgagcaagagaatacggattggaataaagaagatatcgactggaatgctatcgacagccagttgatttcacaacgcattgtcgttacccgtccagagttgaacgggaagaagttgggagctcttcgtcttcgtaatcattacggaatcaatatcagccgtgtataccgttcgggtgtgcagttgttggctactcccgaactgacattgcagttgggtgaccgcctgacagtagtcggtgaagcagctgccattcagaatgtggaaaaggtacttggaaatgctgttaaaagcttgaaagaacccaatcttgtggctgtgtttgtaggcattatcctgggattggctctgggtgccgtgccgttttcaattcccggtatcagtacacccattcgcctcggattggcggggggacctatcattgtgggtatcctgatcggaactttcggtccccgtttgcatatgattacttataccacccgtagtgccaatctgatgctgcgtgctttgggattgtcactttaccttgcctgcctgggattggatgcaggtgcccatttcttcgatacggtttttcgtcccgaaggtcttttgtggatcggtcttggcttcggtctgaccgttgtgcctactgtgcttgtgggtttctttgcttttaagattatgaagatcgactttggtagcgtttccggcatgttatgtggcagtatggccaatccgatggcgctgaactatgccaatgataccattcccggggataatccgtcggtagcttatgctacggtttatccgttgagtatgttcctccgcgtcattatagcccaggtgttgctcatgtttcttctgtaatcattttagggtgaattttaaaattgtaaatcgttaaatcgtaaatcatatgactgctcaaagtaatataacccccgaaagtatcgttgccgatctgcgttatctgcaactgctttcacgcagcttcccgaccattgccgccgccagtaccgaaattatcaatcttgaagctattttgaatctccctaaaggaaccgaacactttctgactgatatacatggcgaatatgaagctttccagcatgtgctgaagaacgcttcgggagccgtaaagcggaaagtaaacgagatcttcggccacactctccgtgaaattgagaagaaagagctttgtacccttatttattatccggaagagaaactgcagttgataaaagctaccgaaacagatattgacgattggtatctgatcacgctcaatcagctggtgaaggtgtgccagaatgtatcttccaaatatacccgttcgaaggttcgcaaatcattgccggccgagttctcctatatcattcaggaattacttcacgagtcaactatcgagcccaataagcatgcttatatcaatgtgattatcagtactatcatttcaacccgtcgtgccgacgattttatcatagccatgtgcaatctgatacagcgtcttacgatcgattcactccatatcgttggcgatatctacgaccgtggtccaggtgcccatatcattatggatactttgtgcgattatcacaatttcgatatccaatgggggaatcacgatattctctggatgggagcggcatcgggaaatgaagcgtgcatggccaatgtcattcgcctttccatgcgatatggtaatctcgggacattggaagacggttatggcattaatcttttgccgcttgctacttttgcgatggatacttacgcagatgatccctgcactatttttgcgcctaagaccaattttgccgattctacttataatgaaaagaccttgaggttgattacccagatgcataaagccatcactatcattcagtttaagctggaggcaggcatcatcaatcgtcgtccggagtttggtatggaaggacgcaaactacttgagaaaatcgattttgaacgaggggtatttgtttatgagggcaaagaatattcgttgcgtgacacaaacttccccacggtcgatccggcagacccttatcgcctgagtgatgaagaacaggagttgatcgaaaagatacactattcgtttatgaatagtgagaagttgaagaagcatatgcgttgtctctttacctatggaggtatgtatctggtgtgcaattccaatctgctttatcatgcctctgtgcctctcaacgaagatggaagtttcaaacatgtgaatatctgcggaaaagaatactggggaaagaatttgctggataagatcgatcagctaatccgtacggcttattttgatgaagatgacgaagaggagaaacgctttgcgatggattatatctggtatctgtggtgtggtccggatgctccctcgttcgataaagataagatggctacttttgaacgttatttcattgcggacaaaagtttgcataaagagacgaaaggatattattatgcgttgcgtaataaagaagaaatctgtgaccgtatccttgaagaattcggagtgacgggacaacatactcatattatcaacgggcatgtaccggtaaaaaccataaaaggggaacaacccatgaaagcaggtggaaaattattggtgatcgatggcggcttttcaaaagcctatcaaccggagaccggtattgccggatatacgctggtgtatcattcgcatgggctgcagttggtccagcatgaacctttccagtctactcagaaggcaatagaggaggggcaggacattaagtcgactacttttgttattgaattcaattcacagcggatgatggtgaaagataccgataaggggaaagagctggtaacgcaaattcaagatttaaagaagttattggtagcttatcggatcgggttgatcaaggagaaggtctgatcaggttcaccacagagtctcacagaggaataatttaaatataaactctgtgagactctgtggtaaatcaattagaacagaaccactcccgcttcagcgatcagtcccttgtcataagtcttggctttattatagtaacggctgccaccataaccgccggttacgaataaaccgaatttatccgtaaaccgatattccagattgaggcgtgcctgtaaggcatagagacgcgccggaataccttctacttttttattccggaaagtttcgatgtgctgaaagcctaaatcgccacttacaaacagatttttgtagagaggaagttcgagacctgcccggtagaataaagctgcagaaaatttgtcattgaagtcgagataatgtgtacctccaccgagtatagtgtagaagagtttgttcttaaagcgggcacctacattgattttggttctgttgcctccaaataccattaattgtactttggtttgcggatttgcattgaccagtcccaattggagccctttcatgtcatctttataataattgaaaagtccgatttgcaatcctttcgctttcgacgcaaaattgaacaaccccaattgtgctccgttcatttggccgccggtcacgttggcgagtgcggagagttgcaatccattcattttttctcccactacattcagcagtcccgacatcataagtccgtcatattcctcaccggttacgttggcaaggcctgccagttgtacacctgcggctttatcacctgtgatgttcatgataccactgatcattaatccgcgtgtattgtctccggcgatattgcttaagccggtaatcaatacgcctttcgctttatttcccgtaatatttacgagtcccgagacggacaatcctgccaggtcgttaccatttacgttactgatacctccaatttgtacgccacgcatacttcctccggcaagattggcgagcccggagatttgaacaccgttcatatcgttttgcaccatactgccgaaagcattgatacctacaccatgtaacttatgcatagccgagaaaagtcccaggttgacataagtagtctgtgtactgtcaagtggttgcgtacatgcttttttccataaagaaagattgattcccccacttttgtttccgcctttattctgtgcaggcagacagactgcagccgaaagaagagctgctacaagaattattttcttcataagctaaatttttagaacgcaaattacgcagatttgcacggattatcctattaaaatctatgcaaatctgcgtaatcgatgtttttttaagaaagatagagactgcttttatccttttgcctcttgatataagaagcgtttgatactcttcttcggagtcttttcaaactcttccggatagattttcattttcgaaatctggctgtaggcaggaagcatttcgttcaaggtaacccggttttcttccatcacccgttccatgtcttcatttttcagaccatgcgcaaaggcttcgtcaaaatccggataaaccagtcccaccagtttgtcattctgctgtacgataatactttcggccacgtacggcagattgttcagcttatcttctatttcttccggatagatattctgtccgctggcactcaataacatattcttgctgcgtcccttaattgtgatgttgccttcagcatcttctagggcaaggtcgccggtatgtaaccatccgtctttatcgatcacctgggcggtagcctcttcattcttatagtagcctaacattacgttcggacctttgcagacaatttcgcctactacgttttccggatcgggtgaaaggactttcacttccatgttgagtgctgcttttccacatgatcccggcttgaaacgtttccaatcttcataacaaatgataggaccgcactcggtcataccatagcccactgtataagggaagtcgatcattctcaggaattgttccacctcctggttgaaggcagctccacctacaatgacagcttcaaagttgccgccaaagccttttatcatctcttcgcgtaccgttgctttaatcttatcattgataatcggcactttaagcagcagcttcatggtaggagtctccaacttcggaagtacgctcttcttgatgatcttttcaataatcagcggaacagccacgatcagattgggtttcacgtcggcaaacgcctggaagataatcttcgggctcggcatgcgggtgaggaagtaaatctggcaacctaccgcaaattcatacaggaactcgaaggccagtccgtacatgtgtgccatcggcagcatggatacgatcttatcacctgctttcagtggaagtacctcgaaagcgaaagctgtattcgaccataagctgcgataggggagcattacaccttttgaatagctggtggttcccgaggtatagttgataacagccaattcttcaggctgatccttatgatattcgatatgttccttacggaaatttttggggaatttcttgccgaacatttcgttgaggtgttcacgtgcgtgagtcagtcgttcgctacgtgataccaataacgtaaaatcgttcatcatcaggataccttcaagtaacggcatggcagactcattgaggttttcccagaccacgtctcctacaaacaggagtttggcctccgagtgattgacgatgttgtgtacgttatcagctttgaattcgtgtaagatggggacgataaccgctccataagtgagagtcgcgaggaaagtaactccccaatgggaactatttcttccgcaaacggctattttgtctcctttgcggattccgctttcttcaaagatgatgtggagcttttctattttgcgggctacgtctttatactgtagggtggcacctttataatctgtcagggcgtccaaatcccaattattcttaatactattttcaatgtaagctataaaactttgttccattgttttttgcacatttgatgataaattgtgcaaatatagctatttaattgagatttgaaagcttggaagctatttaaatttttcttttgcaggtttcactgtattcactacagggtacacggaggatatagaagttctgttttcctttctattttatcactctgtatcctcctatgccctctgtggtgaatgattatcccagataccactcgtacattctctgtaccccctcttcaatatcaatcttatgatgccatccgaggttgtgcaatttcgacggatcggtaagttttcgcatggttccgtccggtttactgctgtcaaaagtcagtttaccctgatagccgactgtatttacaatcagtccggccagttcgcggattgtaatttctttgccggtacctatattgatgtggcagttgcggatgtcttttgcaccggctttgtaggtatctttgaagtccacatgttccattacgaagacactggcatctgccatttcttcactccaaagaaattcccttagaggcgttcctgttccccaaagtgtcacctccgtttcagtaatgccgtatttccggagaatccggaggatttcttcgttggagttggcaccactgatgccttctaccggacgcaggttcatatctttacgcacggcctcccaatctccttttttcaagcagtgtgccaagtgaattttacggatcatggcaggcagcacatgactgcgttccaagtcaaagttatcgttcggcccatacaggttggtcggcatcacggcgatgtagttcgttccatattgcaggttgaagctttcgcacattttcagtccggctattttggctatggcataaggttcattggtatattccagtggagaagtgagcaagacgtcctctttcatcggctgttcggcatcccgcggatagatgcaggtactgcccagaaagagcagttttttcacctgatgccggaaactttctccgattacgttctgctgtatctgtaagttcttatagataaagtccgcacggtagatactattggccatgatccctccgacaaaagcggcagccaaaaacacgtactccggcatttcctcatcaaaaaactgctttacggccgcaccgtccaataagtccagttccttatgtgtgcgtcccaccagattcgtataccccttttcctgcaggtttttccatatagccgaacccaccagtccgtggtgtccggctacataaatttttgcgtttttatccattctgtcaatcatgtttagtcgcaatcattcttttcactttggccatatcgtggcgtaccatgatttttaccagttccgggaatggtgttttgcatggattccatcccaatacggttctggctttggtcgggttaccgagcaattgttccacttcggcagggcggaagtatttcgggtcgacctctaccagtactttgccggtggctgtgtcgattcctttctcattgacgccttcgccttcccaacgcaggttgatgcctatttcggcaaatgccagtgtacagaattcgcggacggtatgcatttcgccggtagcgattacgaaatcttcgggtacatcatgttgcaggatcagccacatacattctacataatctttggcatagccccagtcacgcttggcatccaggttacccaaatataatttatcctgttcgccttgtgcgatgcgtgctgctgccagcgtgatcttacgggttacgaaagtctcgccacggcgttcactctcgtgattgaataagataccgtttacggcaaacattccgtaactttcacgatagttcttggtgatccagaaaccgtattgcttggctactccatacggagaacgcggatagaacggagtcgtttcgctttgcggcacttcctgtacttttccgtagagttcggaagtggaagcctggtagatgcgtgtctgtttttccagtcccaggatgcggacagcttcaagcatacgcaatgtaccgagtgcatccgcctcggcggtatattccggtacgtcgaacgatacttttacgtggctttgtgccgccaggttgtatatttcgtcgggttgtacttgctggatgatgcggatcagtgaacttgagtcggtcatatctccgtagtgcaggttgactgtacgtttctgtttcatatcgcgcacccattcatcaaagtacaagtgttcgatccggcctgtattgaaagaagatgaacggcgcaggatgccgtgtacttcgtaacctttctgaagaagaaactcggcgaggaatgaaccatcctgtccggtaatacctgaaataagagcttttttcatgtctattgttttgagtttataatctttttgacgatgcaatattcggtattttcataagaacgggcaatctatctgctgaattattttcttttttcaacggaaaaaacttatctttgctgtaatttattaaaatagaaatgaatattatgctttttaatattaaaatatctattctattttatataatgaattttattttaaataaattcgtatatgaatgatatatttgatgaattggtatcatccaactactggaatgaaaaacttccgaaagtggaatttgcccgtaaaagttacacaaaccgtatattcgggtatgtaggtaaccgccttgtaaaggtcctgaccggacagagaggggtaggtaaaggatgcctgttgcggcagatcatctatcagttgattgccgatggtgtttcatcacggaacattctatatataagtaagaagttcacagattcgggcgtactttccggctatcgtgatctggacgacttgctttttatctatcgtgagaaaatccatccggtaggtaaagtctatatttttattgaagaaatacaaaaagtggagggctgggaacattttgtccattcccattcacaggactttgtagatacttgcgagctgtttatcagtggttccaaccaggatatgctttcgggtgaagccgagaagcttttggccagacattacgtcagttttgagatatttccctttagcttttccgagcacaggatattggagagggtagaggctaccggtaaaaattacgcggaatatatgggtaagggggcactacccattcttttcaatcttccggatgcggaggccggatggaaagccatttccgctctccgcgatacgattctgtttcgtgatatcatccgccgatatcggattaaggatgcccgcctgctcgaagatgtgttcgtctatttgtgcacccatctcgctgagttgattaccatcagtcagctggtcagtcactttgctgcccagaaccggaagacgagttatgatacggttgccaattatatctgctatctggaagacacctctctgattcatcgcgtggaacgttatcagatccgcagtaaagagattcttctgggtagctgcaaatactatattaacgattgggcatttatgcgccatctgtatcctttttttgccggttcccgaaaatcctgctttgagaaccaggtttatctggaactgcggcgtgccggatataccgtttttgtaggtgtgcttcgaggaggcaaactggtcgatttcgttggcaggaagaaagaccgcattgtgtatttgcaatgtgcacctctgctcaatgatgattttcaagtggagcaaatgtacaacacgctggagatgatacaagacaattatgaaaagtgggtcgtttctatggacgataccacattgccttccaaagaagggattcgtcacatacaagtctggcaactgcctgaaatactatagtctgacaatattttttgattgctttgatgtccggatgatgccgtttacgaagttaacatcttgttgtttacgaagttaatatcataattttacgaagttaaaatcgtatcttcgggaagttaacttcctgaagtcacgattttaacttcgtattagtgctttttgaatcgcttttcaatcccttgagaatcagtgcccgtttccggaggaaaacagctgcgttctttaattgattgcaagcaaacagcattttccagaatataaaaatgtactgtttgtcagaaaagttcttttttaggttccgcttcttttctttgcccggttcaacgctgcgatcatgtattttccttttgctccgatgttactccagttcgtgctgcaaatcagtttccatacaggggttccttttctcccgtaatctgacagtcgcaggattgcttcgatctctttttcgtctgttattccgaatcgttccaggtttcccattaatcccacgtagttgtgtgtcattgtattaaatgcgtatccgggcatactgaccggcgtagcattgacttcctcttccttcccccttgggggagctgaggggggaaattctctactttgctttactttactttgttcggtattgcatgcattttttgcatcagagcctgcatcctgctctacattttgcgtgcagacggtcttttcttcattacatgtctctttcggttttatcagtagataaggcatggctgtccagttcctctttcttcgcttggttgcctctatccatactttttgtattgcttcagaggtcagtactttatgttccgcatagcttcccctgtctatcattcctttctcgatcattatctcgataatcccctgcacctcttctgcgtctgcctcttttcccgtcttgttggcgaaaataaggcattgttcctcaccccacggaatataatatccttctttatatattttgcataggagtttcagtacaatcgcgagtcctttcatgccatattttgcttctattacctccattgcgttctcttccataaaattcacagctatcggaaagtaatttattccatcgtatgttgttgccataattgttaagttgttatgttgctgattaattggtcactgaaagattctcctatacgatcgctctccattccatgaaattctctattttgaaggtcatccacctttgttgctccacatcccggtagaccactgtgttttttatttccatcggatcatactgctttccgaaatctttttcgtatcccaccaatgttcctttcaccagtttgaatgtcccgtcctgtttcatataagctacggctgcatgtccatattgcatatattctatgagggcttccagtcgttctgccatccattcggagcactgttcggtgtagtctttttcgagcatgatttgtcttttccattttcctttcatcatttcgtttttcgatactgctttcctgttctttttcataatcgatttttttaagtttattaatgagttattgtcgggcttttatttttacccatggcaaagtacggtaataagttttgaatagactaatcctgtaaaagtactttagaaagggacttttacaggattttaacaatcggttattcgccttcgtctcgctttttccggaatgctctggcatattttttcagctctgatagaaaagaacgtttattaggctctgtagcaatgcctttgcgctgatattcaaaggtgagatattcttttattgtttcctgtagttcttcaatgggtctgttttccatactgttgattccgcctttgataaaactttcggtaagtgcctccattagctttcctttgccttttgtgatgcgtagtggttctctaaccttttgattgaggctgaattgcaagtcggctttaccctcaaagattacttttccatttacttcgatgtttactaagttatcattcaatgagataactactttttttcttccataatgttagttattaaatgaatttatgaaaaggcaaagtttgtataaaaaaatataaaaatgaaagaatgtcggattttttttagtttagaggggaaagctgcaaaagtaagatccttattattagttttttatcttaaaatataggtgttgtttcaaaaaacgttcgtttgattgaacaaaggtaagcagtctgttttaatgtacaaaatatttagtggataaaatttcatcaaagattttatattattgattttcaaacacatatagaataaaaaaagttctctgctcagctgctttacaatattcattttttcattgaaaaaagtctcaaaaatgccgtttcaaaagacgaacgttttttgaaacacattcgttcgttctcaacttctaaaatagtttcgtaaaaatttacggtttgaaagagaaaagatgtctcgttcaaaccgcgaagcgcacccgaaacaaaggaaaatctccccaagtataaatcgtaaatgtctgaacaacagaagtattggtttgccgcccgtacccgagataaacaagagtttgctattcgtgactctcttgaaaaattgaagactgaacttgatctcaattactatcttcccactcaatttgtcatccggcagttgaagtaccgtcgaaaacgagtggaagtccctgttattaagaatcttatcttcatccaagctaccaagcaagatgcttgtgatatttctaataaatacaatatccagcttttttatatgaaagacctgcttaccagagctatgctgatagtccctgacaaacagatgcaggacttcatatttgtcatggatttagatccgaatggcgtcagtttcgataatgaccatttatctgtcggcagcagagttcaggtagttaaaggtgatttctgtggtgtcgagggcgaacttgccagcgaggccaataaaacttatgttgttattcgtattgccggtgtattgagcgccagcgtcaaagttcctaaaagttatttacgtgtcatttaagttatgaatacactcacttctcaaattgaacaattacagagtctcgcgcacgagttactctatttaggtgtggatggtgctcctatttataccgatcatttccgtcagttgaacaaggaagttttagaacaatccgatgcgttgtatcctcagcgtggtgctactcccgaagaggaggcaaacatctgtctggcattattgatgggttacaatgcaaccatctataatcagggtgacaaggaggagaaaaagcaagttgttctcaatcgttgttgggacgtgcttgaccaacttcctgctactttattgaaatgccagttgttgacttattgttatggtgaggtgtttgaagaggagttggcgaaagaggcgcatactatcatagaaagttggaaagataaagaactttctgaagataaaaaagaggcaatcaataatttgagaaatttggaagaaaatccatatccttatagtgaaatggaataaaataattctatttttttttatttatttgacttatgaaaggcattgttttagctgggggctctggtacacgtttatatcctataactaaaggagtaagcaaacaacttcttccaattttcgataaacccatgatttattatcccatctctgtacttatgttagctgggatacgagaaatactaattatttctactcctcatgacttaccgggttttcaacgtttactgggcgatggttctgattttggagtacattttgagtatgcagagcagccttctcctgatggtttagcacaagcatttattattggagagaagtttattggcagtgattctgtatgcctggttcttggcgataatatcttttatgggcaaggttttacgcctaaattacatgatgcagttaatgcagctgaacaggcagagaaagccactgtttttggctattgggtgaatgatcccgaacgttacggagtagtggattttgataaagaaggcaaggcggttagtattgaagagaaacctgctgtccctaaatctaattatgcagttgtaggtttatacttttatccgaatagtgtgatagatattgttaaggggataaaaccttcttctcgcggagaattagaaattacaacagttaatcaaatgtatttgaatatgggagctttgcaggttcagttactgggtcgtggctttgcttggttggatacgggtacacatgattctttgtcggaagcaagtacttttattgaagtgatagagaaacgtcagggattgaaagtcgcctgtttagagggtattgctctgagacacggttggatttctacagagaaaatgaaaaaaatggcacagcctatgatgaagaatcagtatgggcagtatttgcttaaagtaatagaagaactttctaaaaatgaaaactgaatcagctcaaatcatagagcttcctaaaatcttggataaacgaggtaacttatccattatcgaagaattcaagaatattcctttcaaaatagaacgaacttactggatttatgatgttccaggaggagagtcacgtgggggacatgcatataaagaaaatgaagaatttattgtggctttatccgggagttttgatgtggttttggatgatggtaacaataagaaagttttttctttaaatcgttcctattatgggctttatgtacctaaaggcttatggcgtgaaatgaataatttttctacgaattcgttggctttggtattagcgtctactccttataatgccaatgattatatttatgattatcaatattttttaatttgtaatcaatgataggttctcttcaatctttgagattcttttttgctggaatgatatttctacatcattttattgtaaatggtgaaggcctttttaatgcgggtggcccatgcggagtatcattttttatgatattgagtggcttcgtgatgtttgtagggtatggttcaaaagtacaaatgcattcttttagttataagaattttctatataaaagaatcattcgaatttatccgttgcatttattgtgcctacttggatttttgatattacaccgcttctttttatctttgtttgattatttgacattactaccaaatcttttgttgttgcaaagttggattcctcaatcaagttactatttttcaggaaatgcagtatcgtggtgtctttcgtgcatgctatttttttatatggctttcccttttatagtaagcagattgaataagtactcaagatgtaagctatgtattataggtttgcttgttatgatgatgtatttttttttactttattttcttccagataaatgggaacatcctattttatatatatcaccactgcttagagtcttagattttataataggtatattgttgtgtcgattatattatatgttggaagaacgaggcgtaggagctaaattacggtcttattcatttaggaccaaatctttattggaattatttccagtatttctactttctgttatgttattgctctattcggatattcctcaacggtatacttatgcttcatattggtggtttgtaatgcctctttttattttaatatttgcattgtttaataaatcggggggggtaatatcccaattgttaaactatccttttttacttttattaggtgagtttagttttactttttatatgattcatatacttgttatggatgtcttcaatgcttgtgttcgtcattttcatcttaatataccttggggggtattacttccgatatattttatatcggtaacaatattaagttattgtgtatacagatactatgaaaagccgatagcctctaaattaaggaaaagattatgaatcacttattgacagtctatgattgttctatcatagaactccctaaaatagagaatcgctcgggaaatataactcctgttcatgggaatttaaatatcccttttattataaaaagagtgttttattcttatgatatccccggaggtgaggcacgtggggctcatgcccataaggagtgccatcaatttctgatagcggctagtggatcatttgaggtcgtactggatgatggagttaataaacgtacgatattgttgaatcgccctttttacggtttacatattcctccgggtatttgggcttctgaacaggggttttcttccggttcagtttgtttagtattagcatctcacggatacgaagaggaagattatctaagagattaccaaagctttttaagttataaatcacaaatgattttcaaaatgtttataaatgttaacggggggggggggtaaaccctaattttgtttatccacctatcttttttactgaattcaaaaaggaggtggcataatgaaaaatacctgtgtttatgactgtacgataattgaattagataagcaccatcatactaaaggtaacattactgtagtcggaaacggccaaacaataccttttgatgtacagcgcatttattatttatatgatattcctggtggtgaaagtcgtggtggacatgctcataaggaacttcggcaattgattgttgctgccagtggtagttttaccgttactttagacgatggaaaagttagacgttcctttgttctgaatcgtccttatcaaggtcttttagtagttcccggtatttggagaactttagatgatttttcgtctggagcagtttgtttggtattggcttcccatatttatgatgaacatgattatataagagattatcaagattttataaggtacaaaaatgattagaatacatccatcttccgaagttttatctcaacaaatagggaatgatacctatatttggcagtattgtataattttacccggtgcagaaattggttcgaactgtaatatttgtgccaatgtgctgattgagaatgatgttaaattgggcaataatgttacggtaaaatccggtgttcagttgtgggacggagtaaccttggaagataatgtcttcatcggtcctaatgtaactttcactaatgataaagtacctcgttctaaaatgtatcctgatttatttttaaagactttaattaaaaaaggtgcatcaataggcgctaactcaacaattgtagcaggacatacaattggtgaatatgcgtttgtgggtgcaggtagtgtcgtaaccaaagacattccggccaatactgtttggtatggtaacccggctgttcatcatggatatattactaatgagggggtattattagatttagaaagaaaagataaaaatggattgaaacatataatataaagtaatgataaaattcttagatttacaaaaaataacacagaaatactcacaggaaattcatgaggctgttaaccgggttgttgacagtggctggtatcttcagggcaaagaaaatgaagaattcgaaacgaattactccaagtacataggggcgaaatatacagtgggatgtgctaatggcttagacgctttgatttggatttttcgggcttatattgaattagggattatgcaaacgggtgatgaagtgattgtgccggctaatacctatattgcttctattctagccatttcagaaaatggtttgaaacctgtactggtagaaccttccattgagacttatcaaattgatgataatcggatagaagctgcaattacttctaaaacgcgagcaatattcatagtacacttatatggtcagtgtgcctatactgataagattggtaaaatttgtaagcaatataatctaaagttaatagaggataacgcacaagcgcatggctgtttgtataatgggaaaaaaacgggttcattgggtgatgcagccggacatagtttttatcctggcaagaatcttggtgcgtttggtgacgccggtgctgtaactaccaatgatcaagaattagcaaaggtaatacgtgccattgctaactacggttcaacaaagaaatatgtatttaaatatataggtcgtaatagccgtttggatgaaatacaggcagccgtgttgaatgtaaaattgaaatatttagatgaagatgtagctattcggaaagaagtagcaaagtattatattgataatgtcaggaatcctaaaataattgttccaatagtaaatgattgggatagccatgtttttcatatatttcctattcgttgcacacagcgcgatgaactgcagaaatatttggctgataatggtgtgcagactattattcattacccaatacctcctcataaacaagagtgctataaagagtggaatgatttaagtcttccaattacagaacaaattcatgcagaggagttgagtttgccgataagtccggtaatgaatttgtgtgatataaaaaacattgtaaaaatattgaatgtatattagaaatatgaagtcttttcttaaaaaaacactcaagtatatattgggaaaaaagagtatgattcctcaagatcaggctcttgtattatatccatctttggctttaaagcaattgagtactgtaaatacagaaagtcgaattgactctattattttttcgaaggatcgcgccatccaattacatgcttttattgaatcttattttgaaaaagtggatggagctgataggctttttgtgttatataaagccacaggagagcatgtctcaagttatgaagaattaaagcaagtatggagtgggtatgatgttctgtttatagaagagactgatttccgtaagcaattaaatgagatttgcgtaaaatctactgctaaactcttagggttttatgttgatgatatgatttttacggaatgtgtgtcatataatgaaatcctacgttataatccattggagtatatagtatgtcttagtcgtggacttgactttacttactcccaagtattaaataaaacgatgactttgcctgtttttgagagagtggaagatagtgctttttattcttttcattgggattatagtgatgagtttaatgactggacttatccgttaggagtctctgcttatttttattcaaggcatgagattgtggcgatgttcgatcttattttttataaagcccctaattcgttggaatctgctatgcaaatattgatgccttattttaaagtgcgtaaggggttatgtatggatcggatctcttgttgttgtgtgccagtaaatatggtacaggaagaatgtgtgaatcctgttaccggacatatttcaacacagggcttattggagaagtggaatcaaggattgaaaatagatatttcaaagtttgaaaaggtaggagttaagggcatctacatggattatgaatacataacaagatagatggaagagaataaaaaatcgtcttaccgtggtatcatgaaaggtactgctatctttgggggagttcaggttttcaatattttgataaatgtaatccgtggtaaacttgtggctttcctccttggaccagaaggaatgggtatttctgcgttatttgtttccactactaatataataactcaattcactggttttggattacaattgagctctatcaaggatatatcgcaagcctatgaaggacatgacaggtatgcattgtcacgaactgctaaaatttttcagcggttaatgattcttacgggaggaatagctgctcttatttccttgcttggagcctcatggctgagtacttttacttttgggaccgacgaatattcttgggggtttgttgccctttctattatgttgttcttttcttccatttctacagctgaaacaacaatattacaggggacaaggcaacttaagtcactagcaaagtcatccatgtttggtgccgttggaggattattaataggtgtcccactatattattttcttggggtagatggtatagttcctgctatggtagtagctgcaataactacatacatcataaatcgatcatattgtaacagactgaatttagataatccaaaactgggatttaaggaggtagtacatgaaggtaggaatatgatgtcacttggggtggttatgatgatctctacacttattggtgcgattgtgctgtatttaattaatgtatttattaggcgatatggaaatgcggctgatgttggtctatatcaggctgcatcgtctataacaaatcaatatgtaggacttgttttttcagctatggcagtggactatctaccccgtttagctgctatctctacggataatattaaggtgcgtgatattgttactaaccagcttgagattgttatgttagttgtgactcctctggtaataggaataattgtgactgctcctttagttgtaagattactattaacacaagatttcttgccgattgtagaactcctcaggctaatgggagttggtttgtttcttaaggcttttatttatccgatagggtatatctctttttcaaagggagataagaaggtctttttttggatggacggagtcttctccaatcaaattactttgatattaagcctgttggggtattgcttttatggattgaatgggttaggtgttgcatttattattgctaatgttttgggtataatagttttgttgagtgttgtgtattggagatataattttcgcttatcttataaattatttcctatgttaggcggtttggggagttttgtagtggtagcttatacttgttttgaactgtttggggaatctgttctttcttatatattaggtgtgattgtgttaattgttgtttgtatctattcattgataatgcttgataaaatgttatctattaaagaatggtttgccttaaaatatatgcgaaaaggtaatgaataatcatgcaagagcagataatctatttcggaaaatcttaattttatgttgtcgttgacgttgttttgtctgaataacaaacattatgctataggtttaaaccgatttttcataagagtaatttgctctaatcttggaatgtatttaatatgaggatgaataacagagtttatggtgctgataaggataattggttgagagattaatcctatgtttttgaaattaagaaagatgtaattttctaaaaatttcttttatgaatgataatttattagtcacgatatgtgtacttacctataattcatcttgttatgtcttagacacattaaacagtattaaggagcaaacttataaaaatatagagataattatttgtgatgatgcttcaagtgatactacccttgatatttgcgaaaaatggatacgggaacacgggaaaagatttgtaaatactcagattatcacagtggctcaaaacacaggtatacctgcaaattgtaatagaggacttgaaaaatcggctggggaatggatcaaatatatagcaggagatgactgcttgtatcctaatgccatttatgaatatatcaattgtgtagaaaggaatccctcagaacttgcgttttatgccaatactagtgtatatgatggggattttaaggaggaaaatttttctcgaatagagaatatttatccaaaggcttttaagtctaaaatgagtactgcatggatgcagtataatttattgtcattaggatgtattatatatgctccgactgtatttttgaataaaaagttgcttttacatttaggaggatttgatgaaaatataaagctatgtgaggattggcctatgtggttaaatattacataccatggttataggtttcactatatggatgtcaccacgaccaaatatcgcgtgcatgaaaaatctgtttttggtggagcttcagttggtttactatttagtcggttttacgcaatagagaagttaatttatgatcgatatattagaaataaagctttactaataattcaatttgcatttttatatcattattatttgagaattatccttgatagagtaggtatgaataaacaaaattggttttgtggggttatatacacatttttaatttttccattagcttttattgaaaagattatttttaaattgtgtgcttttaagcaatcttacttatgcccacgtatttgactgttatgttatctaaacgacaaatattctgtaagtgtaagtgtcttttgaggagataagatgtgttgcatttatttgttttgggtgtgcgctcctttgaatatctacgattttattagagtttctctgattagaaacttaatttcatatattatataatgaaagtgtcaataattatacctgtatataaagtcgaaaaatatataatacgatgtctgacttcagtttcgaaacagagttatgaaaatattgagtgtataattgtggatgattgtactcctgatatctctatgaagcttgtttatgattttattgagaattatcatggcgatatatgttttagtattgtttctcatgatgtaaatcgaggattgtctgctgcacgtaatacggggattcgtaatgctacgggagattatatttacttccttgatagtgatgatgaattatatgcgtcagattctatttataaaatgattaaattgggcaaaaagtataatgctgatattgttgttggagagtttatgctgataggtggacgaaaaatttctagcaatctaaataaagtatctgcatatgtggcaaataacaatgctcgaagttattatttacgtggatacttttatttgacagcatgtaataaattggttaaaaggagtttaattataggtaatcaagtttattttttcgagggaattatccatgaggattttcattggggttttttgatttctaaatatttgcaatctgtagccgtttgctacgattatacgtacaaatattatattaacagtggttcaataacgtcatcagagacaataaaagatgttgactcttttgtgaggattattgaaaatatgcttagtaatgtaagtctaaataacttgagagttgaatcgaattttatatcatttgttacgattcaattatttattattatactaaagtggaatttattggagaaagagaaattaagaaaaatgatttttgaaatgagacgtatttgtttaggtatgtttttgtattcaattttgactataaatttgaaaacattgtatcgaattattccattatattgttcttgtaatattttctcttattatttaaaaaataaaataatgaaggaacaatcatgaaaatagctattataggatcgaaatcttttgattcattagagtataatttgaatgaatcttttaattataacggttacgaatgtcaaatatttgatatttatgatcattggttgtttaaggcaaagtctatttctaaatatgcccttcagttagactttttaggaagacgttttagtgactcttatgatcaaagagtttttaaccaattatataaaagagtagaggtatataagcctgatttagtgattggaatatatagatttattcatccatcatttgtggctaagataaaatatcttggttgtaaaatcatacatattaatcctgatgctttaacaacatttgaatttcagcagatattcgcgtcagattatgatatgtggttaactaaagatccatatattgtttcttttatgagaggtaatatgcacttgaatgtaaaatattacaatgaagcttttaacgtgcgtattcatcctaaacctaaaataataaaagagcaatatgagagagaagtcgggattgatgttatgacatatggaactttgtatccctatcgtactcgtatgctaaaaagtctattagatagtgggattaatttaaagttgtatggaactaaacctaatcgtttttatgatcatagtttggataaagctaatcaaaatcgatttataacaggtgaggaaaaagccaggttattgtatggagcaaagatagtatttaataatatgcattttgcagagatagaatctgtaaataatcgtttttttgaggtaaatggtgccggagcttttcaattatcagactatcgcccaattctgaaggatttacttcctgttgatccggagttggttagctttaaatctattgatgaaggcattgaaaaaataaaatattatttggaacatccaaatgaaagatatgaaatatcggctaaaatatacaaacattttgtagataattatacttacgaccacttgattaaatatataatcaattcggtttataaataaaagatgtacttattctcgaccttatcgttgtcaatcattgcttctttggatatcttttcgaagaaaaagcgatatagatcgttgttgtggtttatttgttttttcttattaatctttcatgatggctttcgatgggagataggaactgattggcaaccatattacactttctttcaaacatgtacagatattgttaaaagtgattatgatataggatatacactatttaatcagtttgttcgtttgtttacggatagttattctgtttttctaatattatttgctattattcagtatatatttgtttttgaatcgatctctaagtattcaatagctccttttctttctctttttttatattattgtctttcattaccagtattaggtatgaatagacagttcatagctttgtgtttatgtctgtttgctattagatatattgtttcaagggaaattgtgaaatttttgatgtgtctactggtagcatttacttttcataaatcagttgtaatttttgctcctgcatatttcttgtgtaaaagttatcctctcaaatactatggattattgcttttcctagttatagggatatcgttgtctggtataataaacaaattacctttggaatatttcgctttattgggtcaagattctgcagatagaatggatttttacgctgatagttttttaaagggtgatgtatccacttcgttagttgggtcaatattagctattttaaaacgaagtatttggatacttcttcttcttttcttttcaaaatatataaaaaaaaatgaatattatgcaatagcatttaatttgtattatatagcattattgctttatattttatttaataatacaataatgcaaattatagtaggtagagggttgatatattttaatataatggaaatctttatagtaccatttgtgcttaccatgtttaaaaataattggggaaagttgattctgttttttttgattgtattctacggatatacaaatttagttaaaggaataaattattatccagaagtatttattccctataaaaacatattttaatttcagatgaagcttctattattatatcgtaaatcagggataaattatagtattgaaagggtgtttgatgtccttttggagattttacaaaaggatgttgacgtttacaaagtaacagttccgtattataaaattaaattgctccacttactaaagaatatgtgttattgttataggaggaggaaagaaatcaatcacattactggtgacgtgcattattgtggactgttattaccatctggtaagacaatattgacgattcatgacacggtttcgctaactatctattcggggttttatagagtcttgatttacttgttttggtattattggcctttacgttctgtaaagtatgtgacttgtatctcggagaaaacgaaagctgagttattacgctattttccttgggctgaaaagaaaataagagtaatttataatccagttagtcctgattatgtatttttagaaaaagttctttgcaaagagattcctaaaatattacatattggaacgagagaaaataaaaatctatttcgggttatacaggctttgcataacatttcttgtgagttgcgtattatcggggagttaacagaagaacagattgctgcactaagaaaatatgggattaattatatagtaaaaactcacttgacagacaatgaaatagtgaaagagtatcgagagtgtgacatagtgagttttccttctatatatgaggggtttggtatgccaattattgaaggacaggctacagggcgtgtggtgttgacttctgatatcgcccctatgaatgagatagctggagaggctgcttggtttgttaatccgtatgatgttgagtctatcaggaatgggtttataaagttgatcaatgatgcagagttgaggaatgagttgataactaaaggaaaagagaatgttaaacgctttgctgttgagcagattgctgccgattatttgaatttatatcgagaagtttttaatgggtaatatcattgttaacgccacagcttccagagctagtggagctttatccatattaaagcaatttttagagaatattccagttcataatcaggatatctattacgtttttatagcaaaatcagtggattttgaatcgactcagtatattcattttattccgatagatacttgttcatggatgaaaagaatttattgggacgaattaggattaaaacggtggttggtaaaacgccagattagagctaatttaattatatcttttcaaaatacgggagtaaattgcgcttcacaaataccccagttaatttattaccataatgtaattccgttattaaatattagttggagcatttggcgtaaagatgaatggttgtttctaatatataaatatgtctatccgttttttgtaagacattcattgacggagaacacttatgttgttgtacagcttccttctacaaaggaagcatttatgcacaaattcaaatttcctaaagaacgtctatatattgttcgtcctgatataaaggatattgagctaattcagtgttcagaagttaagttttgtgacgattgttttcactttatttatcctgctactcctttcttatacaagaatcatttagatattgtgtatgcgctatctgcattgcggagtattgatccgagtttgttgaaacagattaagattcactttactctcaatacaggagagttgttgtatttagatacggaaattgctaaaatgggattggaaaaaaactttatattcgaaggtacaattccttttttgcggttgatgtcatattataaatctgtagcggcattgctttttccaagctatttggaatcttttggtttaccgttgttagaggctgccaaagttggtttgcctattgtggtaacagatttaccttatgcaaaagacgtcgttggtacctatgatggggctacttttgtgaaaatgcatgattctgtagcttgggcaaaagcaattcaagcactttgttattcaaagaaaagatatccttcttttattcagcagaaagagaagggatggcctttcttttttaagattattgataatataaaattagtagataatgtcattgtttaaagacaaaatccttttaattaccggtggaacaggttctttcggtaatgccgtattgaaaagatttttggattccgatatcaaagagatccgtatcttttcccgtgatgaaaagaagcaagacgatatgcgccatcaccttcaaaataagaaggtgaaattctacattggtgatgtgcgtgataaacgttctgtggatggagtgatgaatgaggtggactatattttccatgccgctgcactgaaacaagttccctcttgtgagtttttccctgttcaagctgtacggacaaacgtattaggtactgagaatgtgcttgattcagccatcgagcatggagtcaagaatgtagttgtgctctcgacggataaagcttgttatcctatcaatgccatggggatcagtaaagccatgatggaaaaggtcgctattgctaaaggacgtcaaatgggagagggtggtcaaactaccatctgctgtacccgttatggcaatgtgatggcaagccgcggatcagtgatccctttgtgggtggagcaaatgaaggccggcaaggatatcacaataaccgatccgaacatgacccgttttatgatgacactggatgatgcagttgatctggtgatttatgcttttcagcatgggcataatggcgacttgtttgtccaaaaagcacctgcagctactcttgatacgctagcccgttctttaaaggaactttacaaaatagatatccccgtacgtgttatcggtacacgccatggtgagaaactttatgaatcattagtgactcgtgaggaaatggccaaggcggaagatatgggtaattattatcggataccttgtgatgcccgtgatcttaattatgataaatattttgtggaaggacaagagaaggtctctaaattcgaggactaccattcacataatacccatcgtttggatgtggacggtatgaaacagttgttattgaaacttgatatgataaaggaggatgtatgcttaaagtaatgacgattgtcggaactcgtcctgagatcataaagttgagtcgtgtgatggctgagttggacaaatacactgaacatattatggtccataccggtcagaatttcgattatgaactaaatgaaatcttttttcaggaactccgcatccgtaagccggactattttctggatgctgccggaaagaatgccgcagagacgatagccaatgtaattcgtaaatcggatgaattgatggaacaagtgaaaccggatgctttattgttgtatggtgatactaatagctgtatttccgtgatttccgcaaaacggcgtaagattcctatttttcatatggaggccggtaatcgctgttttgaccagcgtgttcctgaagagatcaatcgtaagattgtggatcatttgagtgatatcaatatgcctctttcagagcatgcacgtaaatacttgctggctgaaggtttacgtccggagactgtgatcaaaaccggatcgccaatgacagaggttttgatctatcataaggcggaaatagaagagaatgatgttttagaaaaagaagggttgaaaaaaggtgattactttattgtaagtacgcatcgtgaggaaaatgtggattccgagaagaatttttccgacctgctttcttctctgaacgccattgtggacaaatatcataaaaaggtgattgtttccacccacccccgtacccgcaaaaagttggaatctattggctttattaattccaatccgatgattgagtttatgaaaccttttggcttcatggagtatatcaaacttcaacagaatgctttttgtgttatttctgacagtggtacgatcacggaggaatcttctattcttcattttccggctataactatccgtcaggcacacgagcgacctgaaggtatggatgaagggacgctgatcatgaccggattgaatagtgaccgtattctggagtctatcgaaattgtaacttcccagtatgcagaaggtgcagacgtaattcactctattcctgattatgcttcggataatgtatctaaaaaagtagtccgtatcattctttcctatacagattatatcaaccgtacggtttggcataaagaaatctagttcctgttttttattttttatggttaaaaagaagattctgttgttcggcgccacaggtatggccgggcatatggcttattattatctgcaatgtacggggaaatacgatcttgtgaatgtagtttatcgtacccaattgactgatgatagtattgttgtggatgtgacggatggggatgctgtcagtcggctcgttcgtgaagtccgtcccgattttatcctgaattgtattggcgtattgataagaggttccagagaacatccggacaatgctattctgataaatgcatggttccctcatttgctcaagaaactgtcggatgaagtgggagcaaagttgattcatatcagtacggattgtgttttctccggtaaaaaaggtaactattcagaaactgatttccgggatgctgacgatgtttatggtcgtagcaaagcactcggtgagataatcaatgacaaagatctgacaatccgtacttctatcataggtcctgaattgaaggagaatggcgaaggcttgtttcattggtttatgcatcagcatggttgtgtgaatggtttccagactgctatttggggaggtgtgaccactctggaattggcgaaagccattgatgtggccatcgatcagggagtaaccggtttaatacaactgagtaatggccttggtataagtaaatatgatttgttacatctgttttcccgtatatggcacaaacaagatgttgagatcctgccatttgatggaaatggaatagacaagtcgatcgcaaagtccgcaagatttagttatgttgtacctggatatgaagagatgcttcgggaacaatatgattggatgcagaataaacaggagctataccgaactctatatttatgaaaatattattggtttcccaatacttctggccagagacatttcgtgttaatgatttggcgcaagaacttgtattacggggtaacgaagtgacagtcttaacaggaaaacctaattatcctcaaggggctatttataagggatatagcttttggggctataaaaaagaatattataaaggtattgaactgattcgtgttccgttaatacctcgtggtaaaggttcagggttgcgtttggcattgaattatttgtcttttgtattgttttcttgtttatatatactttttcataagcgaaagtttgatgtttctttaacatttgcaatttctcctattactcaggtgtatgcagctctacttcacaaaaagctgtttggtagtcgtgcttatctttgggttcaggatttgtggcctgaaagtgtgtccgctgcgggtaagatgaattctggtttagtatatcgaatgttaactaagatggtacaaagtatctatcaaaaagtcgatgggatttgtatacagtcggaagcctttagtcagtccatactgcaaaaaggagattataagcataaaattagttatattcctaactgggctgaagatttgttcactgatgattctttgattaataaggaacattttaagtcgttgatccctgatggatttgtcgtaatgtttgccggtaatataggagaggctcaagattttgattcaatattgaaagctgccattcggaccaaagagtataaagatattaagtgggtaattgttggcgatggacgaaaaaaagagtttgtagagcagcaagttaaagagttgaatttatgtgatactgtttttttattaggacgctatcctttggaagacatgccggatctgtttattcatgcagatgtaatgcttgtctctttaaaagaccagaatattttctctttaactattccatcaaagatacaatcttatatggcttttggaaaacctattatttctatgataaatggtattggtaatgaaataataaaggaggcaaactgcggctttacagctaatgccggagattttgaatcgttggcaaacaatgtgaaaagattatctcgaatggataaaaatatgctgtatgaaaaagggagagccgggaaggaatattatcaattatcttttgcaaagaaaaagataattgataatttaatagaagtttttcaatctgagtgatttatttaaataatggaattaaatgaatattcttattacaggggcttatggatttgtaggcactaatctgattaataatttaaaaattaaacacaacctttacggacttgatatcgtgtgtccgacaagagaaggtgtagtgaaaacattttgttggaaagatattgatccagagtcattcccattacaaactctcccccaatttgatgcaatcattcatcttgccggaaaggctcatgatacgaaaaaccaatcagctgctcagtcttattttgatattaataccggtctgactcaaaagatatttgatttctttttggagtcttctgcgaagaaattcatattttttagttcagtaaaagctgcggctgatagtgtagtgggagatatgcttactgaggatgttattccggctcctgttggtccttatggggaaagtaaaataagagctgaagagtatataaaggaacattgtgtatttcctgctgtctcttcctccgagtgttctccttttcgggagatgacttcggttacagaaaaacaggtttatatattaagaccttgtatgattcatggtccggggaataaaggaaatctgaatctattgtataatgtggtgaagaaaggaattccctggccattgggtgacttcgaaaatcgtcgttcgtttacttcaattgataacctatgctatgtgattgagggattattgactaaagaggtacctacgggcatttatcacatgggggatgatgaagctttatcaacaaatgagttgattgccatcatgtgtgaggcaatgggaaaacagccccatatctggaagatgaataagggctttatggaaggatgtgccggactgggaactttactccatttgccactgaatacggaaaggcttcgtaaactgacggagaattatgtggtaagtaatgctaagattaaagctgctctcgggattgataaaatgcctgtgacagctaaagaggggttgattaaaaccattcgttcatttgaagaaactaaataagttatgtactatttaataatcttagttctgctatttctggcagaacttttttatttccgtattgctgataaatgcaatatcatcgataaaccgaacgagcggagttcgcacacccggatcactttgagagggggaggaatcattttcttctttggcgcattagcttactttctgacgaatcagtttgagtatccttggtttatgctggctctgacattgattacttttatcagttttgtagacgacattcgttctacttctcaggggttacgtttggtgtttcattttacggcgatggctttgatgttctatcaatgggggttattcagcctgccttggtggaccattgtggttgctttgattgtttgcacagggattatcaatgcctataattttatggatggtattaatggcattacaggtggatactcgttggtggtgctgacggcattagcatttataaatggggtatatgttccatttgtagagccggctttgatttataccatgctttgtgctgtgttggtctttaacttcttcaatttccggaaacaggcaaagtgttttgcgggggatgtaggttcggttagcattgctttcgtgattctctttctgatcggtatgctgataatccgtacggaaaatttcagctggattgtcttgttggcagtctatggggtggatagtgtgctgacaataattcatcggttgatgttgcatgagaatattggtttgccacatcggaaacatttgtatcagattatggcaaatgagttgaaaattcctcacgtggtggtttcattggtgtatatgttggggcaggcagtagttatagccgggtatcttctatttccggggaatgaatatgggtatttgtcgggtaccattattgcgctgagtttggtctatattctatttatgaagcgtttcttttacttgcatcaagcgaagtgatattgtcaatattatgctttctgccatagatctaatatggtctaaaaaataaaagaagttacagtcgaaaaataatagagttacaaaacaataggcatcaactcctgctatgtgctcatatcgctggtagttgctgacaacactgattaccttgtctacgtatttctccttataggctaccaatgtacccactttccgattccataaaaacacatcaagattttgtatcattattgtttctccttactctttggggaatgaatttatttagttgtttcagtgccattagtggcatgggcaactcaggcagtaaatcacttatacgttgctccatgccgattatccgcaacaatgatatgaaattatttagggtcatgttctgattgacaccttgttcaaaatggcttatagtagcaagactcacaccggatttctccgccatttccttttggctcatccgtgcggcaagcctatactcctttatgcgtttcgctaaaagtagcattatctattggttggtaatatagtccgctttacttatacatggtggaatattactatttaattgcaaaatttaaaaataatatctatatattactactattgtgagactttctgtactggaactatgcatttgtcggatgaactaaaacttaactgatattgggtacatgtgtatgcacctgttttgaacgaagagcttagaattatgatacagataatcagtgtgttataagtttttctgagaaaactgctttccggaccgttctttcctttgccgataatttgtaaatcttcatctttgcagtgttgatcaacgaaacatgaatgaaacgtagtagtaacattagtaaagaaggagaaaaattatgcctttattttatagagcgagacaatcgcagttgaaaactaaagagggaaagaaacagtggcacctcactctggtgaaagttggaaaaatggtaacttcacaacagttggccgaagtaatagctgaaaaatcatcgttgacaccgggtgatgttcataatgtgattcgtaacctgatgactgccatgcgtaaagagttgttaaatagccgttcggtacgtctggagggattaggcactttcacgatgaaagcttgtacacaagggaatggagtggatcaagaggaagaggtgaatccgaatcaggtggcggctcttcgttgtctgtttactccggaatatactcgtcccgcagctatcggcactacccgtgctttgcttcagggagtggaattccagaaagtcagtgcgatagggggagcaattaatggtggatcgggtagtggagatggagatattgtagatgatccgacagcttgataaagtttattgtagatataataatgattgcaaatgaaaggaggtatgaagaatatgaagaaaacgggatggaatattatattgaagttgattattgctgtggcaagtgctgtagccggtgtaatcggtgggcaggctatgacattataaagcggaattaataaccaaacagggtgaactcccgatagctattaaaagctttcgggagtttttcttttccccatgatcttgtctataatcagagcgatggctccatcaccggttacgttacaagctgtaccgaaactgtccatagcgatataaagggcgatcatcaatgcctgggccgattcatcgaaaccgagcatggactggaggatgcctaaagaagccataatagcgcctccggggacaccgggagcagcaaccatcgtgatgccaagcatgaaaatgaaacctgcaaacaaggaaaaatcgaaaggcatgccttgcatcatcattaaggctaaagcgcaggccacaatcttcaaggtacttccggataaatggatagtggcacaaagcgggatgacaaatccggctatatcagctgatacaccgttcttcttggtctgctcgagtgtaacagggatggtggcggctgatgactgagtgcctaaagcggtgaaataagccggcagcatccgtcccaacaagcggaacgggtttttacggacaaacaatgctgcaacagagtactggaagaccaacagaaagatgtgtagtacaaaaatgacgccaatgatcttaataaataccatcaggatggagaatacttgtccggaatgtgtcatgttgagaaagatgccaaagatataaatgggaagtaatgggaggataactgcactgatcatgcgtacgatgatctcctggaagtcgcgtgctacgtttttcaaagcgtcactgtgcagactggcaagtcctaagccgagggtaaaggcaaggacaagtgcggtcatgacattcatcaacggtgggatggcgaccgagaaataaggtagaataccttgggcctcacttacctcgtcgagaggtgctcccggcgtaataagtgagggaaaaacggcagctccggtgaaataggagaggaagccggagaaaagagtggcaccgtaggcaatgagtgcggtgacaagtagcattcgtccggctcctttacctatgtcggcaatggcaatggtgaccaggccgaggatgataagaggaatggagaaattgaggaactctccgaagatggagttgaaggtcacgaacagccgtaccaaaggcgtcggcaggaaatttccgatagcgataccaagtataatagctatgatgatacgtggtaaaagtccgatgtgtattttcttcattacgagtttttagaagtttgttacaaaagtaatattttattctgaaactatccgaacaaatattttcgatatgtgttatagataataagaaatagaacaaaatatcaactgatttagataaatattacaattatggcaactcagaataaaacagatataggcctgattggtttagctgtaatgggagaaaatttagccttgaacatggaaagtagaggatggagcgtatcggtgtataatcgtacggtgcccggtgtggaagaaggcgtggtggaacgttttatgaatggaagggctaaagataagcatatagaggggtttacggacatagaagattttgtgaaatcaattgctgtacctcgtaagattatgatgatggtgcgtgccggtagtccggtggacgaattgatggagcaacttttcccatacctttctccaggtgatatattgattgatggaggtaactcaaattatgaagatacaaaccgcagagtgaaactggcagagtcgaagggatttctgttcgtcggtgccggtgtgtcgggcggagaagagggggctttgaatggagcttctattatgccgggcggttcggaaaaggcatgggaggaggtaaaacctattttgcagagtattgctgccaaagctcccgatggaagtccgtgctgccagtgggtgggacctgccggatcgggacactttgtgaagatgatccataacggaatagagtatggtgatatgcagttgattgctgaagcttattgggtgatgaagaaattactggatatgcctaatgaagaaatggcgtctgtatttgcccgttggaatgaaggtaagttgcggagttatctgatagaaatcacaggcaatatactccgtcataaagataatacaggggtttatctgatcgataaaattctggatgctgccggacagaaggggacaggcaaatggtcggtgatcaacgccatggaattaggtatgccattaggattgattgctacggctgtttttgaacgtagcctgtcggcacagaaggaactccgtgagacggctgcccgtcaataccaatgtaagcattcgatggctgtatataataaacaggatacggaaaaagaaatatttgcggcgttgtatgcttcgaaactggtttcgtatgcacaaggatttgcggtattgcagcgtgcttccgatgcatttggatggaaccttgatttggcttcgattgcacggatgtggagaggtggatgcattattcgtagtattttcctgaatgatattgctgctgcatttgaggcaaaagaaaaaccggaacatttgctgctagctccatattttgagcaagaaatcaaaggattgttgtccggatggaagaatctggtggcgcaggctatgcgtgaagaactacctgttccggctttctcctcagctttgaattatttctattcgttagtgtcggctgaccttccggccaatctgatacaggcacagcgcgattattttggtgctcatacatttgagcggaaagatgagttacgaggagtctttttccatgaaaactggactggacatggaggggatacaaagtcgggtacgtataatgtataagcaaaaaaagaaatatgaataaatttgtaatgactatctttggtgcttcgggtgacttgacgaagcgtaagttgatgccggcattgtattcgttgtatgtagccaagcgtcttccggaagaatttgaaattctcggggtgggacgtacggtttatgaggatgcggactatcggacttacatttatagtgagatggagaaatttgtgaagtcggaagagcagaataaggagaagatggacgctttcgttggacatcttcactatctggcaatagacccggcattggaaagcggatacggacaacttcggctgcgaattgaagaactgagcggggacagccggccggacgatttgttgttttacctggctacacctccatcattgtatggcgtgattccgttgcatctgaaatcagtacatctgaatgaaggtcgtgcgcggattattgttgaaaagccttttgggtatgatctggagtcggccgagaaactgaatcgaatttatgcttccgtatttgatgaacatcagatttaccgaatcgatcatttcttaggtaaagaaactgctcagaatttgttggcttttcgttttgccaatggtattttcgaacctttatggaaccgtaactatatagattatgtggaagtaaccgccgtggaaaatctcggaatcgagcaacgcggcggtttttatgataccacgggtgctcttcgggatatggtgcagaatcatctgatccagttggtggcacttactgccatggagcctcccgctgtgttcaatgcagataacttccgtaatgaagtggtgaaagtatacgagtctctgactcctttgactgaaacggatctgaacgaacacattgtccggggacaatatacagccggaggaaacaaaagagggtaccgggaagagaagaatatagcaccggactcgcgcaccgaaacttatatcgccatgaaactggggatcagtaactggaggtggagcggagtgcctttctatatccggacaggcaaacaaatgccgacgaaagtgacggagattgtcgtacacttccgtgaaactccgcatcagatgttccattgtgcgggtggtaattgtccgagggcaaataaactgattcttcgcttgcagcccaatgaaggtattgtattgaaatttggtatgaaagtgccgggaccgggatttgaggtcaaacaggttacaatggatttcagttatgatcagttgggaggggtacccggaggagatgcttatgcccgcctgatagaagactgtattctgggtgatcagaccctctttacacgaagtgatgccgtagaagcatcctggcatttctttgaccctattttgcgttattggaatgaacatcccgaggcaccgctatacggctatccggcaggaacttggggacctttggaaagtgaagctatgatgcatgaacatggtgccgactggaccaatccatgcaagaatttaacaaacacagatcaatactgcgaattatgaaaccctatattttcccttcgtccatagagacggcacgcgcactgatattacatttggtgaaactgatgttagatgaaccggacagaaccttctgcattgcattcagtggcggaagcactccggcactgatgtttgatttatgggcgaatgaatatacggatatcactccttgggaacgattgaaagtgttttgggtcgacgagcgttgtgtgcctcctgagaattcggatagtaattatgggatgatgaggtcgttgctgctgagtatcgtacctattccgtacgagaatgtgtttcgtatccagggagagaataatccaaagaaagaggctgcccgctattcgaaactggtaatgaaggaggtgccggtgaagaacggttttccggtgttcgatgtagtattgttgggagcaggtaatgacgggcatacatcgtctatttttccggggcaggaagaactgctttcgacagatcatatatatgaggcgaattttaatccgaataacgggcaaaagaggatagctctgacaggaatgccgattttgaatgcgcgtagaatcatcttcctgataacgggaagagtgaagggaccggttgtagaagacatcttttattcgggagatacgggtccggctgcttacatagcccatcatgctgacaatgtggagctgttcatggataacgcggcggcggaaaagattatccgcagataaaaaacaaaaaccgtccgaccttcacaggccggacggtttttgttctatttttgaatacgttatttacatacaacaattaaacagtatgataattaaaataacaactcaacaaaatggaatccgggagaatcacttcggctggattggcttatctcacttaaatgtgacttacgtaataattatgactaattaatgtatggcaaagataggtggttttttgctttggggcaatcactcgatttaggtattgtgaagagggttatcactataagtagggattgagccggccggaaaggaggagtgtgttttgttttatgctctttaagttgtaaatttgcggaaaaacaagagtaatatggaatataagtttgacgaacagagtgtgaaagaattaatggaatgggcgcaagctgcacagctgcctcaagagctggaactgagtaaggcagagcgtatttttgatgtgaagctttgtgtggaatctgatttatcctgtatcagagctcactatccggatgctttttacaatcctgctattactcgtctgtatcgtatcaaggagaagctggaggagaagtgacttccggatatgagtaagtgacttaaaagtatgtaatcaatttgcgattctgtggaatttttccacaataaatgtggaatactcctttatattccactattccaatgaaagctgtttttatataattacttgaaaatgagttgtcgatctggattggcatatgtctggcatgtgtattgcattataatattcagatgtttagttatagttagtagatctagaacaattaagttttcaagaattatgaaaaaggtattagtagcattggtaatagtaatgggattgggattttcagtagtaaaagcagatgaacctctaaagaaaaaatctgcgaaagtggaacagagggactcacgggaagattttacgccaatcgaggttaataatcttcctgaggcagtgattgatgagttatcctgtgagggagcactgattaaagaggcttttatagcctatagtcgttcggaaggtaaactctacaaagtgattatattatcgagcgattttcatgaacaggcagtgttcttgaatgaaagagggaatatactgaatagatagtttcccaatttttgaagaaagcacacaactgaatttatgttaagcctcggttcgaaagaaccggggctatttttttgttcaggagaaatgattctgtatttgagaggtaaatagaatggtttgaaatttataattgtttccgccttttctctttcatacttttgtactgtaagcttacaagagacaggagatttataggcggattctgaaaagcctgatagaaagagtaagagtaaaaagggtattatgatgaaaatcaatggtaagttagtagggaattttttgacagaaggtatgattacggcgctacctgattggtttgttgtattaggtaagtgtggtagtggtagtgaaaaagaaacgttcatgaataaagagagtgtcgtgagaagttgtataaatactgcttggcctcaagaaattgtgccgttatgctatgtacctggtaatatttcatatgtgactttagataaaatgggacagtgtgctatgagttctcaattcactggttgtctaatgagttcgttttggttaaataaaacagtatatggtttgccggtcaataaacaaattatttgtcatatcgcgaatggagacgatatagttaacggtgaatgtattgcaaaggttaataagttaattcctgataatatttcttttaagccatctttgatcattaatctgccaaaatggggggatgattatcaaaatgcttgcaaaaagttaggatacattgttaaaatagaaaccaatatatgtgggattattactgaagataacgaattattttcttttattattggacaaaagaatagcgataataagttatatgttatggcgtggtgccgttgggaagttgatgggaagaaccaaagaatggtagaagcgctttcaatagatgatgaattgaatacatattggggttaaatatgggaattcgatatataaattatcaggatcggttagaaaatgcttattgcggcgggtatgctttggcggccatgattaatttgttcgattcgtcactgactccggataaaccgtatggtaaaagtatttatgatcagattcaggccatacagcgtgcaactctcgataagaacaggaaatgttttattgataggataactcgatatttgcatgatcggaatattgaaggtacatactctctgccttcctcggtctctatgtatgcaaaaaatatgggattgaatccgagagtctgttataatgagtcaaagttgaaagagaatctggtatccgtaataaataatataggtttagaacaatttaatgttgatgatttgataggggaagagatatctctgatagtctcttcgggaataccagttgttgaaaatgttactaatttttctatcatgaactctctggcattggtggaagggggaatgcattggattgctattggcgatataaaagtcgcgagtggagaaaatatgtattacgatcctgaatcagtgggaaaacctccttatgaatattctggcttaaacattgtgttgaatccttttcagtgattttgccgtgttttataggcggattccgaaaagccttgaatagagtaggaaaagcttaagggtattataatatgaaagtatgtatgtcgtctaaaaagggaaacaatggttctgttgctaaaattcaaggtcattactacaataataatgatgactcttgttttcaggaaataaacgaaatggccccaatttctattaaagcttgtaaggggaatcagttgcttattacgcttaccgttttggatacttggtgtgagaaagccggtgacggagcatggtttgctattaaagttaataataaaattgtagcacggggattgtattctgtggcaatggatggacaacgtgttcccattactttacaggcaatggttgatgtcacttcgttggaagaagatattacgatcagagctatgtggtgtaattgtgagggaacttccggcagagcttgctgcataggagaattctcagaatcaatacttactgtgttagtgaatgactggaacatagctaattcaaaattagaagaaatgactaagaatttatctaaaattccgggtctgaaataaggcggacaacgataagtcatggattatacgggcagtgaattaatggcggcatttgttcactgcccgttttgtcggatttatcaaaaaagtaaataaaaaagtcatatctactttatggaagttataattatgggtggtattatttacgggtttcagaataattcatatctttgaagctgtaactaaaactaatcaataatgaagcaaatacatttagattgcctggcagtgaagctgtttctctttttttctctttttagtttgccgtccggggcacagagcatttttcagaaatacgatcgtttcctgacggaacctcgttcatacgtgtgttatcgtgtggacggtaaactgaaaatagatggtaaactggatgaagtttcatggcagaaggcaaaatcgacagctccgtttgtagatatcagtggcgaaggattccctacgcctaaatatgaaactacagctaagatgttgtgggatgatgaatatttgtatgtcggggcaattttacaggaagacgacatcaaggcacgtcttactcagcgggataccattatttactatgataatgattttgaggtttttatagatcctgattgggatggacacaactattttgaaatagagaccaatgcccggggtgttatattcgatttgatgctggacaaaccttatcggtcgggaggcaactttatggtgcaatgggattgtccgggattaaagttggctattcatcgtgaaggtacgttgaataaatcgaaagacaaagataaatattggagtgtggagatggctattcctcataaggcattgactatgaattttaacaacccgttgaaagcaggcaattgctggcgaattaacttctcacgggtacagtggttgaaagccggagggcctgaagaaaattgggtttggacacctacgggaaaggtggatatgcacatgccggatcgttggggatatttgtttttcgctgacgaggcagtaggagcgcccgaacgtactgttgcgctaccgtataatactgctgtgtataaactgctttgggctatgttctatgcacagcaggagagatatgcaaaagagaaaaactatttacgtacggaaaaagattttttcctgacggatgcggagttgaaaggactcccgcagggtgcgcaaatctcagttgaggctacccggaatacataccagatagctattactgttccgggtgaaaacaagcgttacgttattaataatgaaggacgtttctggacagagaagattgctccgcgaaaggtgaagaactgggtatggacacgtataaataagaataaaagtgaagcagattaccgtcagtggtttgctttgcttaaggagtgcggaatcagtggggtgatgtttgaagggtatgatgaaaatctatatcgcatgtgtaaagaagccggtcttgaggcccatttctggaaatggacaatgaatcgtgcggaactgctgaacgtgcatcccgattggtttgcggtgaaccgcaagggggaatctacgcatgataaacctgcttatgtggattattaccgttttctctgtcctaaccatgaaggagtggcgcaatacctggcggatgattatgtgaaaatagctcatttgccttatgtagatggggtacatctggattatgttcgttttccggatgtggttctgcctgtcagtttgtggaaaaattatggcatagagcagacgagtgaacatcctgaatatgattattgctattgtgaggtttgtcgtgccaagtttaaggcgcagacgggacgtgatccgttggaattgaagtatccgatggaagatcagtcatggatcaattttcgtttggatgccattacccgtgttgtagaccggattactgaagcggtgaaagctgacggaaaagcaatttctgccgcagtattcccgggaccttctatggccaagaagatggtacgtcaggattggggaaattggacactggatgcttatttcccgatgatctataacggtttttattacgaagggccggagtggatcggacgttcggttcaagagagtgtgaagacggttgacggacgtgcgaaagtgtatgcaggattgatgtttcctgatataaaaaatgattttgagaaagcattggatgaggcgtttgataatggtgcgtccggtgtctctttctttgacggaccatcggacgaatatcttcataaatttagagcctatctggataagaagggattaaaaacggaataaagcctgtgaaatatgaatgctttaatcaaatgttataaaggataacaatatgcctattatcgaaatatcatccttgtcccatcccggagtagagatattcagtacccttaccgaagctcagttgcgtaatcgtcttgagcctgaaaaggggttgtttatagcggaaagtcccaaagtcattaaagtggctttggatgcaggctatgaacctttagcgattttgtgtgagcaaaaacatatcacgggggatgctgcgaatatcattgaacgctgtggtgatatacccgtctatacaggtgacagagaactgcttgctacgctgaccggatacgttttgacacgtggtgtactttgtgccatgcgtcttccgactccgcgaagtatggaggaagtatgccggagagccaggcgcatcgtgatcatagacggggtggtggatactaccaatatcggtgccatcttccgttcggcggccgctctcggaatagatgcggtattgcttacgcgcaactcttgtagtccattaaaccgacgtgcgatccgggtgtctatgggggcggtcttccttgtaccatggacttggctggatggtcctctcagtgatctggctcggtggggcttccgtacggttgccatggcgcttacggataattctatttccattgatgatcctgtgctgacaaacgaacccaagttggctattgtgatgggtaccgaaggagacgggctctcgcatgagaggattgccgaagcggactatgtcgttcgcatccctatgtcacatggggtcgattcgctcaatgtggctgctgcgtctgccatcgctttctggcaacttcgtgctgagaaagagtattagtgaatacaaagagtaatgtataatgtagaagaacagaaatgaaagataacaagtaaggcagcctcataaggctgccttactttataaattgtaataaggaatatattaattccctctgtatgtagaatacccgttggctgacatagtaatgggaatatgataatgctttttgccttcaattctaaatataacttcgacaaacggatagattgattttaagccttgtttcaggaaataaggctctgtataaaatttaagcatatatatacctgtattatcctctatgcctggtaaaaaattggagattcttccatttacatcagtcttgccggttgcaatctgtttccattggcttggagtggaaggatttaatttatagagggtgatgtcaactccttgtgccggttctcctttactaatatcaagtatgtgtgtacttagctgatggctttctgtttgggcatagatagagaagggcaggaggaataaaataataattaccgagaatttcttgattagttgcgtcatatctgttttcgttattatgattatataattaacaaataaattgaatttatgtttggtttggatcaaagatggatctccataccgacttaccctctttaaccgataaccataccagatatccgccaccaatttcacaaatgccggcaagtatgaagactaaaatagttcttaatataagcatatattcatttttttattattgggtcacaaatatagtttaaaaagagaaggatgaaatcaactggattcgatttacattctcaaatttgctatgccgggagggatgccgcttgatatcccgtcaatgattgtacactgaatacagggcacatcatgaccggaacatcaatgcggcaattaatttttagtcgattcccggctctctccggtcttaatcgtaaaagggctgttaattgttggttaatatttctacagcctgttttaacgtgcgatcaatatgggtataaggtgaaagggccatttcataaatttcttcttcggttagtggttccattaggaagtccggtttaatcccaattccttctattacagtatgagttgcatcctgcattgcaagtaaaggcatataaaactctaagtaatcaccgactttacctctcagccctccgttaaactgatccgaatctcctaatccggcagttgcaccggcactataatgtcctacgacagtgacatgtttcccctggctttttagcattagggtactgatttcagacatacttgcactgttcttgtctaagagaataactaccggtatttctttttttatcccaatgtctgttggctttgtcatgcagggtgtccatggggtataactgaatggattattgtcttctttgaacctctggtagccaaagatggcgtctttggtgataaagcgatctgtaaatgttcttgcatcaagaaccataccgccaccgtttcctctaagatccagtattatcttttttatatccccgtttttgaggggtaccaggaaatttttatagaaatctatcttatattgattgttgataacattatctatatccgagagaaaaattgtatactcacatgctaattgtaaatgctcggtcgagcgttgtttaaaccacttggtataattcggatttagtttaaactcttccaggccgcttagctgtaatagctctaaatttatattgggtgcattctttttggctttgagtaatgcctcgacaaaactctcgtctatagtttcagattgcttaaagttctctattttttttattgcatcttgcgcgatctcggacatcatgaaagagttaaacttatctatatattctatagacttctcaatcaggacactttttacagcagggtcttttattttcgcttcaatggtatctcttatctcttttcctgttaaataatacgggcttttatcatctataaccaagtattcatcaccaaaagaaactatataatcattacttattgtaaacgacttaaaaccgaaatagtatatgtcgggattgtctgataagaagccacctaacatatcatttttatgtccgaatactcctgtgtcaggttgtatcttagacttcatatattcatactttagatcaaaaggataagcatatatcttgtctttactcttcattccaccataaaaaatggtgcttttgaaataactatgtgacacgggaagtgctatttttacatagaaatgttggtctatgataggatcaatgatttctgtaaagtattctattgctttgttacaatcatctgatatttcagctttggtatactgtttatccctgttaaacgtttttaattctttgaactttggagtatattctttatatatcgcttcccagttcaaactactctgttcgtaaaaataattgtatttctggttcattgtattccaaaacacatcgaacaggtcagaatatgattttatatcacttgctgtataccgtgttggttctttggttgattctgtaacgtcttcaacgcaacttccagaaataaagagcacaagaaataaaagaaagaagtgacgtaatgtccaattatattttttagttttcataatctatagttttagaatttataggcgacgcccaatgatattatgtttgagattcttctcgatttacgattcgaagaagtttttgctttgtatatgtcggttagaccatactgataggtgtatgaagcaaaaacatcgatcttcttaaaagaataaccgatttctcctgtgccctctatcccgaacaggtctcttttcaagttattttcatttcgcttgaaatcatacgtttcattcacttgaactctgatataggaaccgtctttctgtaattgtgcaaagatcgggtattctcctttccggtgcattcttgtaaagtattcatagtaaacaccgccttgaattttgagccatacaccattctctttataagggttattgaaaatatataaccctacattcagcggtacattcataaagttgtttttatacagtgtatgcgttcccgtaatattatccgtctttttatattcatagtttctttgtatgaatcccagacctgttcccacaataaagtctttaaagaagttatattcaagatttacaccggttgcaacccctgtttgggtattgtaacgtgtattgaccagattggaaacgtcgctacttaaaatactcttggagataccgacatccaaactaacttttaatttctgtgcttttacagatgaaggaattgttataattcctaacagaatgaaaattgctacttgttttttcataaaattaatgtttaaattaaacaaagaaccaaacggatgttgtggttcgaataagtaaattatggtggattaaattaggtataatacgaacaggtatcgactgtgtattaatgctgtcacgagaaacgtgcaacggaactgtatcatcaatgggattttatgctactcagatccatagcatgctcaatcatattcaggtatcttatgattgaaatatcacttggcgaattcttcttgtggaaagaattcgcctacatctgattatctctataaactttaaatttcttcatatatattcaggttttgattaaaataggtacttctatattttacaaaactattattctatgccggaaaacaaacacatttcattgcttttttttaaatttatatgaaaaataccacaaatatgttagatgatattggtaatattacctttccggtatccatctgactgatgctatttcgtttttttctcttcgatttaaaagaaatctcccggttttcggaaggccaatatgctcatcagaaattcataattgttcccgccctttttatcccatatttttgtatcgtaagcttgcagaaatagttaaaacgtataggtgggtttcgaaaagcctttgatagagtagaacaatatttttagggttatgaatgaaaagatggacacagcaggtttcaatataggaaatattgcgggtaacggaaaagcgggcaacctgcttaatgtgaaaggtatgaagagaggaaattggagttatttcttttcaccaatggtgagatttgaggagaatggtcagaattttcttttttctcttagtgctgatggaaataagattaagttgtcatctctgacgtcagagggagaaggtcaggtttttatcgatgataaatggcattggtattataattctcaggttccgtttgttgagaatggaaaaaattacatattctgttatagtaacagaggaaatcggtggtttatttctgagttatctactaaatgggatggacagaaagaaataaaaaatggccagggattcggcaaagactatgatgttatgatcccctttaatgaaaacggtaaaaattatatttttgctcatagcagttcggataagagttggtttatgactgagttgtccactaattgggatggaaagaacaggattaaagaagggcgttgggcacgtttttacaaggttttgataccttttgtcgaaaatggacgtagttatttgtttgcgcatagtgcacaagacaatcgatggtttgtttctgagttatctacaaaatggaacggtcaatcagaattgagatgtggcaattgggcacgctattacccaagtgtgactgcatttgtgcatttgggcaaacctattgcatatttccacagcgagaaagatagacgttggtttatgtgggaactttctacagatagaagaacagacaaagatttaaataatggaaatctcgattcgttttatgatacggttacttcgttcaaagagaatcaagcatgttatatacttgcacaaagcagcaaaaccaaggagttctttatttgtccggtactttagttgatgtgctttaaatgttatgggcgggttctgaaaagcgatgatagggcaggaagaaatatccgaggtagtatggaaatatgttacttgaatagtaaatcggtacctctggcacccaaagtggctatctccaaatattgtgtaaacggaaaactacgcgattcttctcgttgtttctcttataatcgtgtaaggctccggatcgaaagattcggagcttattgtgtatttattccccaaagtgtgtgtctattccccatttatttcccaatctttttttattatattgaatgtaacttgctgttttatagttgatttgtgacctgttagtattctggcatgtcctttgccttttatttggcataagagttagttttaattattcacactaaaaaattacgattatgaaaaaggtattagtagcattagcaatgattatgggattaggcacttcagtagcatttgccggtgtatcgggtgacactttagcagtagaacaaactctgcagactcctcagaacgaatttacaaaagttgccgcaaaggaacttcctactcctgtcatcaatgcattggccaaagattatgaaggtgcttcgataaaggaggctttcgtttctgaaggagaaaccggtaaggtatataaagtgattgtgactgtaaccaaggaagatcaatctacagaagatatcactgttcttttgaatgaaaaaggtgagattgtgaaggaatagttagcttttcaacttaatttctacttttatggccctggttcttaggaatcggggctttctcatttaagagaaatcctcttgcatccgaaaggttattttccttatcagaaatttataattgcttccaaccttcctattgcatacttttgtatcgtaagcttacactaactttaattaaaaaaacaggaatattatggctattttaaattcaaacaatgcagatgttctatgtactgccattgcagtggggtttattcaccaatcaattgttgaaagaaaaccacaaaggacgcagcttatatatgaacaaaaatcgttagttcaagaaagtaaaacgatgactgtgcaagaaaaagagaggatcgctatagaaaatgcaaaaattagtgataaaaatgcgaaaaccgttcaagagcataaggaaatccaaaaactattggctaatgtggggtgtaatgtagatataaaagaagcacttccgtcatctcacttgccttttgttggggctaaacatggtggaatgacggtagaagagtttagtcaatgggcaaaagactttgaggttgttgtagatcaattacaaaaagctgcccaaaatcctcttcgtggagcatatataggagggctatataagatagtagagaaaactatatcttttataggagcttcaaaattagaaatctattctccccattatagagaaattgacacttacgaacaagaaaaaattagtactgcttacaaagatgcggctaaaactactaatcaatctttagagtgcataaaaaaagtaagtgaacaatttaagtcattaaggcactacatccctacaggatatttaagtggcgaaaaaactccagatactgttactaaagaactcttagaatctttagacattttagatggaaagtttttattcaaaagtaatcatgggatgactcaggctataatgcaatttggaaatactatggataaaaggcaggagatgtgtgttgagtttgctttgagttccggaacttctaagattggttcgtgcattccgtgtagtatttttatggaagcttcaggtatgcctgctactgctactcatttggggtgtggagataactggagtatcccgaatttagaggagcaacgggggcatatgttggtcagacagtggcaagaatacgtaaatagctgctataataaagggtgtgaactattaagacctaaatatagtacattattggcaacattggatacaattacccttgaaattttaccagatgtattccttgaagctctgacatacgaaaaaccatttatagagagaatgatgaatacgctcagactcaaacaagtgtagatgtctcttattagaattataaggtataaatagaaagggcttctaaatcctcctctgaggtagaagcccttcaacacaaaaactaaactagacttaactaaactattctattcttggaagtttcacaacttccgttctgtttgttacaaagatagagatttttttgtttatatataaataataatcgacaaatgctcacattttaccgataaatcagctgcaaacctttcaacttcgttcgtcaaggaaagcttggaaagcttgtttgtagctatcgctgacggggatgtaggtcttatcgaatacgatgcggccgcggtcgatgatgcgtattttgtccttttggacaatgaaagagcggtgtacacgcataaagcgggtggggggaagcagctcttccatggacttcatactcataagtgataggatgggcttgggagcatcttcggtatagattttgatatagtccttcagaccttctatgtacaatatctttttgagctctacctgtaccagtttgtagtcgctcttcacgaaaatactgtctatttcctcgggtttctgaacgagttcgaaccactgcaatgccttgttggccgcctgcaggaagtcgacatacgagatgggcttgagcaggtagtccagtgcgttgacccggtatccgtcgatggcgtattgaccgaaggcggtggtaaagacaatacgggtacgggcatctaccattttagagaattccaggccgttaagctccggcatctggatatccaaaaacagcaggtcaatctgatgtcccggaagttctttcatggcttgtacggcgctggaatactttcctgccagttcaaggaaaggggttttgttgacgtaactctccagcaggctgagtgccagaggctcgtcgtctactatggcgcaatgtagtttcacggctgtggatgattaaatattaataatttcgatatatattctttgccatcttcagagatggctttgtcccatcggtagcgtccggggtaagacagttcgaggcgcttgctcacctgttcgaggccgatgcccgatccgcttttatccatattggttttgggatggcagctgttgcgtatttcacaccggatctcttctttattctcagagataaggatgtggatgaagctcggttcggtaggggagatgccgtgtttaaaggcgttctcaataagggagatgaagatcagcggggcgatcttcgtctggctgtccggttgtatgtcgagttgcgtaatgacctctacgtttccagagaggcggatacgcattagttcgatgtagttgcggataaagtcgacctctttgcagagggggacgtagttctgctggttgtcataaagcacatagcggagcagcttgctgagctcctgtacagcctgctgcgctttgtcgctgtcgaaggcaatcagtgcgtagatgttgttcagcgtattgagcaggaagtgcgggttgagctgattgcgcaggtttttcagttcggcttcggtgcggcttttttccgcttcgcggcgggcggcttcggcttctccccagcgggcgctcatgcggatggcggcactcaggccgatggtgaagataaggctcaggatgtcccgtacaaagaagatccatccgggaggcatgtgaggtttttttatgggggggatcggggcattcaggctttgccagatgtgcagcaggaggccgattatgcagaccagcaggatgttatagatgatgtacttgttcttctgttcccggaacaagaggaaggggaccagcaggaagtagttcagatagaatacggtgacaaaggagatgggtacggcagagtggcgcagataggcactccaattgatgctgtttcccgcacgatcgataaagaagaaagggaaaccaaacacgatcccccagctgataatatgtatcagtatttccagagggcggcgggctgatgtcagagactgtttcatggggacaaagatactaattttagtttacgtttgggacgttttgaacaatgaacgataaacggggatcaccacagaggacacagagtttactatatatataatgtataaagaatatataataggcaatgaaagcaatcagcatcataggctttactgatagaatatcgggctttcgtcgttctttatacttttttttactttacgttctcagtgtcctctgtgatagattactcgtatcggattgcctcgatcgggtcgaggtcggctgctttcttggccggataccatccgaagaagaccccggtgacggtgcacacagcaaacgacaggaatacactccagggctggatgaagatgggccaatgggcaacgcttttcacgagccagctggcaccacacccgatgattactccgataaggccgccggtgatactgatcaggatggcttctatcaggaattggctcaggatgtcgattccccgtgcaccgactgacatgcgcaggccgatttcccgggtacgttcggtgacgctgacgtacatgatgttcatgattccgattccgcctaccacaagcgagatgccggcgatgcaggcaagcagggtggtcatcaggtcggtggtggagttgagcatgctgctcagttcctgctggctgcggatggtgaagtcatcatcgtccccttccttgagtttatgattgcggcggaggagttctgtgatttcttccgtggcattgtccgtcatatcctcggtgagggcagaagcgtaaatgccttgcagataggtctgtgccagcaggcgcttcatcacggtggtgtagggggccagtacgatgtcatcctggtccatacccatggagttgtagcctttggacttcagtacgcccactacgcggaacgggattttattgaaccggacaatgcgtcccacggggtcttctccaccggggaaaagattgtctacaatggtttttcctatcacgcacaccttggcgctggactggatatcggcttcgctgaacatctcgccgttgtcgaccgagagctggcgtatctccagatagtccgtacccacgccactgacggatgacggatagttattgttaccggctatcagttgcccggagctggaaacattcgggctgacggcagctaaaaaactggtttcgtcccgcaatgattcgtagtcggtcagtttcagtgtctgcatggcactggggtcctgacggactcctccgcgcatatctgctcccggatggatcatgatcatattggagcccatttcggagatttgtgcctgaatgcttttctttgatccctgtccgatggcgagcatggtgatgacagatgccacaccgataatgattccaagcatcgtaaggaatgcgcgcagcttgttgttgttcagggcacgcagggctattttaaataaattggttccattcataatggtaaggtttttgagtattattcaccacagaggacacagagttttaatattttgtttatcaggatgtttaagagaaatatattctctgtgtcctctgtgtcctctgtggtgaatcgtattcgtttctaaactgtattattcttcctgcacaggcagtgcggccagtgcctcggctgccgaaagaatgttcgggttgacactatcatccttgacctgcccatcgcgcagcacaatgttgcggctgctgtattgggctatttccgggttgtgcgtcacaaagatgatggtacgcccctcggcatgcagtttctgaaacagcaccagaatctcgaaagaggtgcgtgtatcgaggttacccgtcgcttcatccgcgaggatgactgccggattgttgaccaacgcgcgggcgatggctacacgctgcatttgtccgccggacatttggttggatttatgttccaaccggtcgcccaaccctaccgcgcggagggcttcgatggcccgccggcgccgttcggaggcgctgactcccgagttgtacatcagcgggagctccacattctccacggcggtcgttttcggcagcaggttgtagctctgaaagacaaagcctatcttgcggttgcgcaatacggcgcgttgcggcttgctcatggtacgcaccgagataccgtccagcagatattctccactggtgggtgtgtcgaggcaacccaacgtgtttagcaacgtcgactttcccgaaccggaagtacccatgatggtgacaaactccccttcggtgatggtgaacgaaactccgcgcagcgcatgtaccgtttcgtctcccacccggaagttgcgtttgatgttctgaagttcgatgactgttttgctcatacttattttcctttcttcttactgcccgggtggcttggcatgaacgggctttgctctccgccaccgtccggtccggcttcgggtgctacgtttccaccgggcatgcttccgatggttgcttcggtcactactaccattccttcggaggctcctccggtgatttcggtattgataccgttggtgatacctgtctgtacgggatgtgccgtgaatgtatttccttcacgtgtccacagtttatgttcgccctcacagtcttttaccacatccttgtcgcttatcagcggcttttccggggtgaagcgcagtgcgcgtgcgggcacggagagcacgtctttgcggtccagggtataaatggtgacattggctgtcaggcggggtttcaacttcaagtccggattgtgggcggagatcactacttcgtaagtgactacagtggtcgacgtactgctcgtgctggtgctgcttgcgtctcccagtcggatttgcgtgaccgttccttcgaatacgtcgttcgggtaggcatctacggtgaatgtagcccgttgtccttcttccacaccgcctatgtcggcttcatccacatcggccacaacctgcatctgagtcaggtcggcggcaatggtgaatagggtcggtgtttcaaatcccgaagctacggtctgtccttcttccacatcgcggctgatgaccacgccgtcgatcggtgaagtgatggtggcatacgacaggttgcgttccgctttggccaacgaagcctggctgctctcgaacgagctttttgccttttcatagttgtagagcgactgctcgtagtcggtatcgctgatcagcgccttttcgtgcagtccccggctgcgttcatagttcttcttctgatattcgtattccgctttcgctccattgtaagtggcgcgttgtgaagcgagttcactctgcaacgtcacgcggtccatctcggcaatcaactgtcctttggtcactgccgcattatagtccacatagattttgtcgatgattccggatacctgtgtaccgacttccacttccgttaccggttcgatggttcctgtggcggtcaccgattcggatatctcgcctttgctcacggtcgccgtggtataggtcactttgtgcttggccgtcgggcttccgaagagccaaagccctccgcctgccagtacgacgatgcctgcggcgataaggatgatcttttttttattcatatcgtttatacgtattaaatgtttttgttctctgcggtgagtcctgtcaactcgtctccctgatagaacttcagcagttgagtgttcagaatggccatatatttggactgtagcaactcctgctgtgcttgcagcagattgttcttctccgtaagcagttctaccgtattcttcatgccggcattaaactgttcgctgatcagttcatagctggtctgcgtgctgcgcaacttttctacagctgccgcatagcgttgttgtgcgctgttggcatcgagccacaacccttcgatggtcttatacagagttttctgttcatcgagcagcgtcagttggctggtctgatactgaagtttggccttttctacggcgcttttcgtctgccggttgttgaagataggtacgctgatgctgagtccgatggagttattccatccgtttttcacctgttccccgaaggtgaagtcgcttccgctcgtatggtttgtccctattccggctgtcaggctgacgctgggcagatatcccgaccgggctattccgatgcccagttccgaagcctccacactgagtttgcttgcctcgatctccggccgtagggccacggcagcctgaaacacgtctgctttggtgggcaggggcgacagtacattttcgtcacccagcacaggcagatatatctgcatctcctgttcgccgtccagttcgagcagttgtttcagttgcagtttataatcctgaagcgtggcctgtgccgtgaccagttgatagcggtcggtgctgacttgtgcttccagttgggcatagtcgctccgggcgatgcttcccgcatccagcagttgcttgctgcggtcccgctgggcttcggatacttgcagggtgttttcgttcaccttcaccgactcggccgcatacagtatttgtatgtaggtctgggcgatggactgccggatgtcattctccgaagtagccacgtcgaggtccgccacccggttgttgagtttttcctgctcgatggtcttcaggcgtttgctgccgttgtatacggtccattgtgcattcagcccgtagtttccgttgtaggttgtcttgttgctgctcttcagcacttccgatccgctgatgatgctgctcgactcttgatagggacggttcaccagattctggctgctggagaatgaaaggctggggaagagggccgctttggctgtcttcacgtccacctgtgtgctttgtgcgttgattctgttgcgacggatgctgatgttttgctgcaaagcataatcgatgcagctttgcaggtcccaccgggcaggtattgccaccgagtcgctggcctgcatttgtccggaggttccggtttgttgcgcccacaatccgccttcgggcagggtggctgccaggcagagggctatcagggtgattctttttacgtttgtcatacgcttggttctttgattttactgaaacaaaggtacagcgtataagaaagaggcgcaaaagcgatagacgggagcggaggttttaacgataaaagatgaactataatcgatgaatgaagtttaccacggagtgacacagagttccacagagaatcttttttaagatttcctgagtgggaaatgtcccggtgaccggtaactgccctcacaggtaaaaaggaggtgtgtttcaggaactttgatagaagtgtgacctgtcaggtcacacttcttaaaaggtaaatatttacttttgtaagccggaacgtttagaacgatgaactgtatagaaatgaatacgattcaccacagagtacacggaggacacagagttttaatctcttgtttattaagatgtttaagagaaagatactctctgtgttctctgtgtcctccgtggtgaattaaactcaaaaacaaatggaaagaaaacaattttttattcttgagaaagatttcctgaacacacgggaagtgggagacttgatagaagctctcggaccgggaggagtgggagcctatatggcaattctgatctacttgcgtcatcagcctgcctatacgacgtgttacagaccttccttattgagccagttggcgcgttgcaataacggtactgttgagttgttcagagatgtgctgctcaacttcgggctttttgattttggtgaaggagaggagccggagtttcattctttttatctggaccgagtgatggaacctatggaccggagatgtgcaagcagccgtcgtaatggagcgaaaggaggacgtccgccaaaggtggctcgtactgtgcataatgtgattccggaagtgatggaagaggttacggaacctgttgcggaagaacctttgcaacttgctgtggctgaggaagaaaaacccagaaaaacctacaatacaatacagaacaatacagaacaatacaatacaacaacagaaacaacagaaaagagtaaaagcgaaacctccgtgcttgttcctgttgccgccgccattgctgccaccactgccgttgttggggagaacatacaatctttgtttggcttccggacagaccggcggataaggatggacgaaacgcggatcgacaggcaatgctgtatcgggcatatccctatcggtacgaggcattggcgggaggattgcagatctatctcttgtctacctcacttgcttggagtgtccggaagaagtggcgatcggaaaataagggcctccggctgtcagagatctggtccctgactgtcggtgaggtgtagcccggctgtcggtgaggtgtagcccggctgtcggtggggtgtagcccggctgtcggtggggtgtagcccggctgtcggtgggatgtagcccggctgtcggtgagggggtgcccggatgggtatccgtcgtaaaatgttatctttgcacgtatctaaaaacacaatagagtcatgaatacacccgtaaccattccgttgcggaaactcccgatagggatacaaagtttcgaaaaactgcttatcgacgagtacgataaactcgtttggcgactattggttcaccggcggaacccctgctttcctggtggaaatgctgcagaagaccaatttcggtttacgggagatggaaggaatcgaagtgccctccacttcgctgaacgatgaccgtgccaatgtgggcaatcccattcctatgatttatcagagtggctgcctgactatctttgtaataatcagaaacttagattcgattctgtgtcgttctgtgtcctctgtggtgagtaagaaccgtttattttgcttgtttcatcaacatttttaagattatctttgttattatttgtatagacactaattttgatatgttataaaattaccctgtattatgaagaatacactgctccatatctggaacttctatgtcgaaggttttcgaagcatgactctgggccgcaccctgtggctgattatactggtgaaactcttcatcatgttcttcattctccgcctctttttctttcctaactttctgagcagccagcctaccgacaaggacaaggaagaatacgttgcaggcgaactgatacaacgcgggcaataaacggctgaagtttaactctaactactaatgatatgattgaaagtattgacacttcacttattgactggtcgagagcccaatttgctctgacagccatgtaccattggatttttgtgccgctcactctcggcttggcagtcgttatgggtatcatggaaaccctttattataaaacaggcaatgagttctggaaacggacagccaagttttggatgaagattttcggtatcaactttgccgtaggtgtagccacgggactgatccttgagtttgagttcggaaccaactggagtaactattcctggtttgtaggtgatatttttggcgcgccgcttgccatcgagggcattttggctttctttatggaggccacgtttattgccgtcatgtttttcgggtgggataaggtcagcaaaggtttccacctgacttctacctggctcacaggactgggagctacgatctccgcctggtggattctggtagccaatgcctggatgcagcatccggtaggtatggagttcaatcccgatacagtgcgcaacgagatggtcgatttcatggcagttgccttttcgcctgtcgccgttaataaattttgccacacggtgctctcgagttgggtgctgggagctgttttcgtgataggcatcagttgctggttcttgctgaagaagagagacaaggagtttgccatagccagcattaagattggtgccatcttcgggttggtagcttcggtgctgacggtgtggaccggcgacggttccggttatgccgttgcgcaaacacagccgatgaaactggcagcggtagaaggatattacgaaggacagaacggagccgggctggtagctgtcggggtgctgaatcctgataagaagacttatgacgacggtcagaatccgtttttgttccgtatagagattccaaagatgctctccttcctggccgagcgtaaagcagatgcttttgtgccgggcatcaaaaatatcattgaggggggatacgaactgaaagacggcacgaaagcgctttcggctgccgagaaaatagaacggggtaaaaaagcgattactgcattgggcacctatcgtgcggctaaaaaagacggtgacgaggctgctatgcagcaggcatccgccacgctgaaagagaatgttgcctattttggttatggttatattaaggatgtgaaccaattggttcccaatgtgccgctcaacttttatgccttccgcgtgatggtgatcttgggtggatactttatcctgttcttcattgcgattctcttctttgtctataagaaagacctgtcgcaaatgcgatggatgcaatacatcggactatggaccattccgtttgcttacattgccggacaggcaggatgggtagtggccgaatgtggtcgccagccttgggcgatacgggacatgctgcccacgtcggcagccatctcaaagttggatgtaggctctgtacaggccacattcttcatattccttattctgtttacggtaatgctgattgcggaaatcggcatcatggtccgggagatcaagaagggaccggcggctaatcattaatcacgaaccattaatcatttaaactatgggtacatacatttttctacaacaatattggtggctggtagtctcactgctcggggctatactcgtattcttgctgtttgtgcagggtggcaactctctgctgttttgtttgggtaaaacggaggagcatcgcaagatgatggtaaattccaccggacgtaagtgggaatttacgtttaccacactggtcactttcggtggcgcgttttttgcttcatttcctctgttctacagtaccagtttcggcggcgcctattggctttggatgatcattcttttcagcttcgtattgcaggctgtcagctacgaatttcagagcaaagcgggcaacctgctcgggaagaagacttaccgtacttttctggtgatcaacggtgtggtcggccctctgctcttgggaggtgcggtagctaccttcttcacagggtccgatttttatatcaataagggcaatatggtgaacgagattatgcctgtcatcagccattggggcaacggctggcatgggctcgatgcgctgaccaatatctggaatgtgattctgggactggccgtgttttttctggcacgcatcctgggagctctctatttcatcaataacatagccgataaggaactcgtcggcaagtgccgtcgttcgttgattgcgaatacagctctgtttctggtgttcttcctaacttttgtgatccgcactttgctggccgacggatatgctgtcaatccggaaacaaaggagatctatatggaaccttataagtatttcaataactttatcgaaatgccggtagtgctgattatattccttgcaggggttgtgctggtgctgttcggcattggcaaaacaatgttgaagaagacattcgataaagggatctggtttgccggcattggtacggtactcaccgtcctggcactgttgcttactgccggatataacaatacagcttattatccgtcttacacggatatacaaagctctctcacccttgccaacagttgttccagccagtttacgctgaaaaccatggcttacgtttctatcttggttccgtttgtcatcgcctacatcttctacgcctggcgcagcatcgacaatcgtaagatcgatgcaaaggaaatggacgaaggcggacatgcctactaagatttttatcagataaaagtacaggatatcggaattttattacttttgtagcgatgcttatctgctcttgacaaacgaaggcggataagcattgtttttatcagtaattaaacagacatactatgaaacgagtatttgtatttcaagactttaagtctcagaagttctggagcatcgatgttcggggaaccgatgttgttgtgaactatggcaagttgggaacagacggacaaacacaagtaaagaatttctcgtcggtcgaagaggccgaaaaggccgctgccaaattagtggcggagaagacgaagaaaggatatgtggaaacccgggaagaggttgccaaggaaatgaaggtggaagctaaaaagtatgcgctgagctatgacgaggcagaagagggcgtgaacttgatggataggatattgaaggataaaaagctgccgtcgctcaggcagatcacgatcggctgttgggggtacgacggagaggactgctcggctattgccgacggcattgtggcgaataaggaaaagtttgcccatcttgagggcctgttctggggagacatggattctgaagaacaggagatctcctggattgagcaggtggatttaggtccggtgttggacgtgatgcccttgctgaacaatctcaagattaaaggcaccaataatctgagcattggcaagaaacctcgtcccaacctgaagtcacttgagattatcagtggtggcctgcccgattcggtggtggaggacattctgggatccgacctctctaaccttgaaaagctggtcctttatgtaggagtggaagactacggatttgagggtgatctggctgtattcaagcctctcttctccaaagatcgttttcctcaactgaaatggctgggcattgtcgatgcggaagaacaagatgctgttgtggagatgttcctcgaatcggatattcttccgcaactggagacgatggatatttctgccggagtattgacagacgagggagcacaactgttgctggatcatgtggacaagatcagccacttgaagtttatcaatatgaaatacaattacctaagtgacgagatgaaaaaggagttgcagaaggcactgccggtgaagatcgacgtttccgactcacaggagtatgatgatgattacagtttcccaatgattacggagtaaatgaatgaagatatgtgttgtcagtaattcgacttcaaaacgtacggactactttatcaaagcgggtagaagccttggggcggatacctgctttgtcacatacgatgagttgatggctactcttccggagtatcgtgatacggttgtgaagctggaacctccggtgtttcaggaaacggacttccggaaatacaatttgctttgccgggattacagggaaatgttgaggcgcttagccgctgtggatagaccggagggcgtgcattttctgaacgagccgagtgcaattctctgtgctttggataaggtccgcactcagcagaaactggccggggcaggcttgaaaacaaccccgttgttctcggcggcactacgcacttttgatgaactggccgaactgctttaccggcagaagaggggagggtttcttaaacctcgctatggctccggagccggaggggtaatggctgtcagatacaatcatcgccgggacgaatgggtggcttatacgaccatgcgttgggcgggaaatcatgcttgtaatgaaaaacgtatctgccggttgacaaaccggaaagagattgccgtgctggcagaagaagtcatgcgatgcggagctgtccttgaagagtggatggtaaaagaaaaactggaaggggagaattatgacttgcgtgttgtttgtagggaagatgaagtcgactatgtcgtggtacgttgtagcaaaggtaccataaccaatcttcatctgaacaacaaagcaaggctgttcggagagctttcgcttgcaccttccgtccgtgaggagcttttttgccggagcattgccgccacgcgggctctgggactgcggtatgcaggcatagatgtgctgattgcacggaacacggatacaccttatattatagaggtgaacggacagggagatcatatctatcaggatatgtttacggagaataagatatacaccaatcagataagaacgatagaatcacttttcaatggaaatagatgaactgccatccggtaagcaagaccggaaaccggatatagatatgaatggaattgtgggcacgcatgacatactgatgctctgtttcgacaccttgcgctatgacgtcagtgtggccgaagaggcttccgggggaactcccgtactgaatagctatggcagtggctgggagaagaggcatgctcccggcaattttacctatccctcgcatttcgccatttttgccggattcttgccttcacctgccgaaccccatgtgttgcgcagccggaagtggctttttttcccttttcaggccggcacggggcgcatacctccggagggcagttatgcttttaaagaagctacattcgtacagagcctgtccaatatcggttatgaaaccatctgtatcggcggagtcagctttttcagtaaacggaatgacatcggaagggtatttcccggttatttcaataaaagttactggctgcctgcttttggctgcacggataagaacagtgccgccaatcaggtggactttgctgtcggtaaactggaaaagtatccggcggaccggagagtattcatgtatatcaatttctcggccatccattatcccaactgccattatgtagagggtaagaagaaagacgacaaagagtcgcatgctgcggctttacgatacgttgacagtcaattgccccgcttgttcgaggctttcagaagacgttcggatacattggtcattgctttgtccgatcatggtacctgttatggtgaggacggttacgagtatcactgcatttcccacgagaaggtatatacggtgccttataaacattttattctcagaaaatgaacgatcagcagcagatttcacgatatatcagctatatgtacagttatccgcataagacggcttaccgtacttttaatcctccggtctctcttgccccttattttgaacggttggcaggggggcaggcaagtctatattttcatatccctttctgtgcccataagtgcggttattgcaatctgttttcacagcagagctgtgatggagggcgtatctcggcatatctccgtacgatgcgccgtcaggcagaacagttgtccgtggcggcacaagatctgaaatttacttcgtttgcagttgggggaggtactccgcttattctgaacgaaaaacagttggatgaactgttttgcatagccgagctgttcggcgtacgtccttcggaggtattcacttccatcgaaacttcaccggagtatgccgacaagaaagttttgcggcaattgcggacgaggggggtggaacggttgagcatgggtgtacagagtttcaatgatgcggagttgaaaaaactgaaaaggaggcctgtgcttgctaccgtgatcgatgcacttcaaaatattcgggaagcggacttcccgcagttgaacctcgacctgatttatggcattgagggacagacggtggatagctttattcactcgcttaccactgcgcttacttatcgccccgacgaattatttatttatcctctttatgtccggccgggtacacgtatcgatgtacgctcaacggatgacatgtgttatgctatttacaggtcagctcgtgaactgttggtggagcagggatttgtgcagacttccatgcgtcgctttgttaaacggaaaacagtggaactggagttctcctgtggcgatgaaaccatgctgtcctgtggttccgggggacggagctatctgggagatttacattatgccactccatacgctgtgcggcaggaagccatagccggagagatagaccgttatatccggactgctgattttttgacggtaaccaatggttatttgctttccgcggaagaggtacaaataaggtttattataaagaacctgatgtattatcgggggctggacacggcggagtatgaacgacgttttggtaaggagccggacagaacgctcttccgggaatttacagaccgggggtggattgaagagaaaaaccgggttctgcttcttacggaggaaggaatggcctactccgattacatcggccagtcttttgtttcacctgccgtaaggagactgatgtccgagtatatatatccttgatcaactttgcacgatgggggctttgagtactatccggaatatctattataggggcagtctggaatattgcaactatacatgttcgtattgtccgtttggcaggaaatccgcatctgccgatacggacggtgaccgggaagcgctgcaccgttttatttcacgtatcggtcagtggaagcatggggcgttgcgtattctgattatcccttatggagaagcgatgatacatcggtattacagagaaggtatcattcgtctggctgccatgccccatgtggccggggtttcttgtcagaccaacctgtccttttcagtttcccgttttctggatgaagttgaagaggctcgggcagatgtcaccaaaatcaaattctgggggagctaccatcctgagatggcggatgtcacagattttgcgtctaaaatagaaaaactgcatgcggctggtattgaggtctgtgcgggagtggttggtgatccttcggcaaaggaacagatccggaggttgaggctgctgctggatccgtcggtttacttgtttgtgaacgcaatgcaaggtttacggaagccgctttcggaggaagatgtccgtttttttaacgagatggataatctgttcgattatgatcggcggaacgcaaaagcatgtttgaataattgttccggaggcagagagagtctgtttgttgaccgggaaggggggatgtatgcctgcccgagaagtggggtgcggacagggaatttctacgatgattctgcttcgctccttcagccttcttgtctccgtaaagtatgcgattgctatattgctttcagcaatctgcgggatacgcctctgagaagaatgatgggagaaggggcattgtggcgtataccggagaggaaaaaggtcagggctgtattctttgatattgacggtacattgacagatgtgcaggggaggattcccgggcgtaccgtttctgcactaaaatatatgtccggtcgcttacctctgtacctgagtactgccttgccgatggcacacgccaagaagcggcttggtgatgtgttcgacttgttttcgggaggggtttttgccgatgggggctttctgtgttatgaagataccgttgaatgtgttccggttgaacatcctgtggctcttgatttccccggttgccggatcactcgttatacttggaaaggggaaatctttaagtatgccgtgcttgcgcctactgtccgggaagctactcggttgtcggccggattggagggggaggcatatcaactgtatcaggaaggccggttgctgacagtggtggacagcagggcgggaaaaaagaatggactgatgactctatgttcgaggttgggaatctctttgcgggagattctggtggtaggtaatacgatgcacgattggccgatgatgtcagttgccggttattcttgtgcagtgatggatgcggaagaagagttgaagaaactatcgggatatattttgaatcccgatagtattcctgtcttttttgatatctgactttatttggctacgttgtttatgggttttccaccgatgtatgctttcaggttgtcaaccagaatggtcatcagacgttcacgggcggcggaagtagcccaggctatatgcggggtgatatagcaatttctggcagtcagcaatgggttgtccgcacgtggaggctcggtggagagtacatccaatccggcagcataaatcttataattattcagggcgtctgccaggtcttgttcattgatcaaagggccgcgactggtgttgattaagatggcgtttggtttcatcagttcaaggcgacgggcattaaccagatcacgggttgattccgttaacggacaatgcagactgacgatgtcgcattcacggaaaatctggtcgagttccgcttttctgatttcgggaggcaactgaagccgtgacttggaggtataggcccacactttcattccgaacccgattgcgatacgggctgtattatatccggtctgtcccagtccgataagaccgattttctttcctaacagctctataagcggggtatcccagtaacaaaaatcctgattccgggtccactgccctccacgcacttcgtctgcatagtgttgcactcgctgagtgatattcaggatatgggcaaaaaccatctgtccgacggatggagtgctgtaagccgggatgttggtaaccacaataccgcgttctttggctgccgcaatatcaataatgttatatccggtggctattacgccgatatacttcaggttaggcaaagaggccatgtgctctgcggtgatcacggctttgttggtaaggatggcctcggcgtccttcgcatgtgtaagcacctcttcgggggctgtgcgatcatagatttcacactcacctaaagttctcaattcatcccagttcagatctccggggttggcggcatagccgtctaaaactactatcttcataaattattaggtgttaagtattaagtttgtgtacttgaatactgaattaataactctttatctaataaaacaattacagatgtttaatagttcttttcatttccccagagttgtttcattcgttcggcatgtttctgttcagccgggttgtgttggggctgccatatttgcttattcttgatttcgtccggcaggaattgctgttttacgaaattaccttcataattatgggcatatttatattcctggccatatcctaactgcttcatcagtttggtgggagcattgcgcaggtgcagaggtaccggtaggttgccggtttcgcgcaccaatgccagtgcatcgttgatagcattgtaggctgagttgcttttagggctggttgccagataaatggtggtttccgccaatgggattcttccttccggccagcctattttcatcaacgtgtcaaaacaggcattagccaatagcagtgcattcggattggccaggccaatgtcttccgaagccgagatgaccagacgtctggcaatgaatgccgggtcttctcctccttctaccatacgtgccagccagtaaatggcaccgtcgggatcgctgccccggatcgatttgataaatgctgaaataatatcgtaatgcatctcgccgtctttatcataagccagcggattctgctgtaagcgttcggttaccagatcgtcagtgataactacggtctcttccgtttccgactctactacgagttccagtatattcagcagcttgcgggcatcgcctcccgaaaaacgaagcatggcactggtttctttcagttctattttacgttctttcagtacggtatcggtagtgatggcacgttgaagcaattcaagcaggtcctctttctccagagacttcagtgtatagagctggcaacgggagaggagtggacggattacctcaaaagacgggttctccgtggtggcacctatcagagtaactgtcccgtgttcgacagctcccagcaacgagtcctgctgagatttgctgaatcggtgtatttcgtcgataaacaagatgggactggactgagtgaagaatttgttgcttttggcgcgatctatcacttcgcgcacgtctttcacgcccgatgttacggcactcagtgtataaaaaggggtttccagcttattggctattatctgggccagtgttgttttaccgactcccggaggcccccacaggataaatgaagagatacgtcctgcatcaatcatcttgcgcaagatagcacccggtcccacaaggtgtttctgaccgatataatcatctaatgtctttggccgtagcctttccgctaatggttgcatatctatttgtaatgaatctgtttattagtcgatcaccgtccccatcacctgtacatctgtgatagcggctttttctccgatgaaactgatacgtatgaaacgtccctgtatacccggaacaacctggatcatccgaatgttctcgttttgtttatagttggtctgatccggaataagtgtccagtgttctctatccatcgatgcctccactttgtattggtaatggtccgtatccggaaatgtgattcggatgtggcgtatggacaaacctttctctgtgtccaatgtccaggagcgttccgggtcgttgccggcagcttgccaataggtggctccatctccatcggcagcaaatgcggacgagtgtccgtcggccgatgaactgcagaaggtcggattattgggcccgaaggtttgcaggttatctgttttatcctgaacctcaaaacgtgtataaggtcggtctttcactttgcaggcttcggtatagggagtgcttccgatgaaccggagtgtgatctcggcaggctcgagccccggcgaggtagcccgtatcacggtttctccggcatagtatgaccggaattcaatcgcggcttttccatcgagaatacggatatcactctctttttcaaataggatcgaggtaccggtaggaaactctcccggaccggatatgatgttgaggctgactgccggagaattgttgaccggtttaccgtctgcatccagaatggttaccgacaacataacgtcatctgtcccgtctgtctttatctggttcgtttgatcggctgtcagggcaatgcgtgcaggtgttcctgcctctggccacttcggcggagcaatccctttgtaggcattgcggtaccaataccaggcacgtttgggaatccggaaataatcgataattcccattttcccaagagcacttccggctatactcccgtggtcgaatgcgcaccagatggcttgtccgctacgccaggcaaagccattttgcgcattattctttgccaagtctccccagcccggatcgtactctcccggacggtcggctgtcgtgctgccatactctgaaactaccgtcggtatgcccggttgctggaactcggggatgtagctaccgtcaccgttatatccggctatatcacccaacttgtcaattcgtttctctcccaacggacgttgagcaccgccaatggccgccggacgggttggatcgagttgcttggagagtttgacggtttctgacagtaacttgcgcatcgggtcgatcgtttcgggtgcggtaaagaacggttcgttactcatactccatacaataatagaaggatggttgcggtggatgcgaatcaattctttcagttgggcttttacactgctctcaaatcctgccctgtctgcttcatttacgggatatgcacttgcgttccagtagccatctcctttgtgacctccgattccccaaaatgcattctctgcccagaatagcatacctatttcatcgcatgcttgtgagaaagccggtgaatgggggtaatgcgaacctcgtatcaggttgaagccggcttcttttaccagacggatatctcttcgcataccggtttcggtcacggcatctccccatccggcatgatcctgatgaacattggctcccttaaaataataatgttccccgttcaggaagaatccccggtccggtgtccattcaaaccagcggaatccgaaagacgtttcatagcggtctatcaatttttctccgtggtaaagcgagctgaccaccttgtaaagtgcaggatgatcgggatgccacagctccggtgcctgaatctcgcgggtttgctgctcaaatgtgtaggttgcgttgtccggcaatgattgtgatgtagaaacagaagccgcttctttgcctcggggatcgataacagtggtcagaagtcggtaagtttctgtttttccggaacgattgcatacatctgtccgtatgtggacgctccctgactttccctttttttctcctaagtccggtgtggtgaccaatgtgccataccaatcgatataggtcggttctttgatcactaagcgtacgttcctgtaaatgcctccgctgaatacatgttcgcctgcacgtggagcgaggtcaggtcgccagcagttgttaacccgaaccgctatctggttttttccttctttcagatagttcgatatatcaatggaaaatccggtatatcctccttggtgggttcctgcccgatgtccgttcacaaaaacttctgcttcctgaaatacaccgtcgaattcaagaaagctccttttgccaagcacttctttctttatcggaaaggctttacggtaccatccgtaacctacataaaaatctttcgacatgaagtatggagtactgaaagagtggggaagtcccgtcctttcccagtcggaatcgtcaaaatccggtcgggaagcactcttgaagtctccccggcaatatttccattcccggttgaagttgatggtttgtcgtggggaatccgcccggcaaacatggattgcactgcttaacataagaaaaaccaaccatagcttcatgccattgcaggtgtgtactgtgaaattcatcgtattgaggttttatagtgtgaatgatagataggcggatcagaatactacctgaatcataaaccggataccttgtttgttgattcccgggtggttcaggtaagtcagacggcgtacgtattcgatatgcaacaatttaaagatgttgtaaatgcccacactggcttccaggtaaggtactttcggatccatcacatagctggtgtagctgccgtcccgttgcgggaaatcaaacagttccggattattgctcttaaacgggttatttttatccgtcaggttgccgtatagagcgcggaaacggaatacttctctccacttcagtttcttaatcagcgggatgcggttgaaaagtttaccattcatgtcatatgtgagtgccagcgatgcataacggtcgttgaggaactccatattattgatcaggttgaacgtttctttctgtgtgatatacgataggttggcggctggcaaaataagtaatgggaacggaacggtattccattgtgcacctccttttaaggtaacatctactttaccccaggacgagagccagaagcgcttccagatacttgcctccgtcaggttgaaattatattctcctcctaaaacacctttaaatccggtagtgtgggagagggtgaagatgggagcatccagcgataccggacgacggcgttgctttgtattgacgaaggtctcgcccggcgcataacgtaaggtcagccccaattcggcggtagttatatcgggtacgatggttttggcagcatcattgcggatgtattgcaacttgcctgccggagtatcttcccggtgtcgcgccatggccgcaaccgagaaacccgataaagtttccatttcatatctcagtgtggcgtcccgtacgtatgacatctggtcgacggttgtggttttccacgctacgaatacgttatccttatccgtgtcgaggaatttatccattggcgacatgacgtcgtagcggtaggaggccgagatgtaatgcttcgggaattcccaggggaagaattcgcatttgcggaaagagtaggtcacattaccttcatatttccattttttatctttgagtccgtacgctccgtatccattgaagaaccagtggggattcagcttggcggtagtcataccgctgagacggaaacgggtaccatccacataattgctcgatatcatggtgttgatcggtccgaagtcaaacttactcggatgttctttggtcccggtttccacatagttttctatcaacgcttttgctccgaatatcacatatttgaatccgggtatttgttccagccggttcatgaaaagatccatgctgctctcggtctttgttagaggcacctggcgtactccggcccaatattcgtcacttttggtcagcatgtccgcctctttgatcacacttcctttcaaacggaaaagtcgtggctcgatggggtcgaagacataattgctatatttggttgttcgttttacctggatgccctgaatagctttcatgactaaaagatccacagtcatatcgtcgtctgtcagcacccagttgccattgggaagctgttcatattgctgtacgacgtccagattttctacaaagtttactcctgtctttttaggcagattcatggtgcactttttcactgcataggtagagtcgtccagtacatacaggtgtccggtgaatccgaagtcctgagagttctgtgggacgaaggtgagatgcacgcatttatctttatccaccatcacagtgtccatcaggtagaatttatagaaagagatggctccgcttccgattggacttacgaaacggcgttgcaacaggcggatatcatcatcatagatattgatatcggcaaatacatcattgaggatggtacccagcatatcacctgttgagaagaattcttccacgccattggagttcataccttcgattatggtctttttgctttccgggtccttccggtaaatggttttggaagacgtttcctgcaccgagataggcagaatcagtttgttggtttcaggcgaaacctcaacctggtctttgaggaaagaaaactttttatagattcctttttcaaggctttcgggtgtcacgtcattgagtgacatcttcatcttctgatacttgttgtactgataatagtcgttggtttccagcttctgagctttcttgtggccgatgacctttcgcatgaactccacagcgggattgtttttccgggaatacttttcttttttaggttttatcaccacctcgtccagcatgacatcatctggtgagagcaccacattcagttctttggcacctgccggaattttcactttcttggtgatataccccactgcagagaaggtcagttcgttccaacctttgcgggtttctacctgatattctccgttagcattggatataccgcctacgccttttccttcatagaaaacggaaatgtacattagcggctcatgtgaaatagaatcagtgattactcccttcaactgtgcaaaagcctgtggtgcagagagtataaggaagactactattaatagtttagaatattgttgtttcatacacacttcatctcatcgtgagactgcaaaggtaataaattccttttgattgaacggactatataaccttttttgtgtatcttttgagtcctgtaaggagggggaatccggcattattcccccaataatatttgtacaattcgttctgcggtccgtccgtcccagcgttcgggcagggtgccttgtttccattctccgttcatcagtttatccatactggcagccaatgctgccggatcttccccaaccagttcgttggtgcctgtgcgccaggtttccggatgctcggcataggtgttgagggtgatgcagggaattcccaggaaggtcgcttcttccgccacattgcctgaatctgttataatggcttttgcctggttcatcagatacccgaaagagagatagctttgtgtgggcatgatgtgcaggttaggagctgtgatatcgagagttttgatcgcattgcgtacataagtgtgcagtggtgccacaatcggcatgccgtttgccttttcaagtaaggtctctatcaatttccgcagattttctttgttgttcagcagcacatggcggttgagggtcagcaggatgtactcatgctctttcagtcccaggacagagaaccatattggctttatcaggcggttgcggttataccgtattgtatcgatcaggatgttgcctacatagtagactgtttcattttctgttcctgtctgattcaggttacgattggccaccatgccggctgtgaacagatagtcggaaagtccgtctgttatcatacgattgacttctttaggcatggacatatcgaacgaacgggtgccggctacgagatgtgccacttttatattttgttttttggctacgatcgcacaactcatagttgcagtgaggtcatcgactaccagaactacgtgcgtagggttttccgtcagttcacgttcgaaggcgatcattattcccgcagtaagttctgtggggttattgccgtttacgcccagataggcattgggagctttcatatgcagatctgcaaataaggatgcatccagactggtgtcattctctatccctgtgtaaaccaggcgataagaaatgcgtttaccttgtgccttagcggcatcaatagcccgggtgataggggcgattttcataaagttagggcgagccccggcaacaatcgttatcttcatcttcgtattcttacaattttcaaggaacaaatgtacactttcttgcggaattatttgtttctttgcacacaaaaaacttgatatatgccaacaatctttcagattccgacctttatccagattctggagtttatcgggacatttgcttttgccattagtggcattcgtcttgcatctgccaaacagtttgactggtttggtgcttatgtagccggtgtggctgttgccattggcggtggtactatacgtgacgtattgctggacgttactccgttctggatgacgaatcccatttatcttatctgttcggcgctggcccttctgtgggttatttttttccggaagcatctgattcatatgcacaacacgttttttatcttcgatagtattgggcttgcattatttacggtagttggtatcagcaaaacgatcgatttgggctatgccttttgggtggccatcattatgggcacaatgaccggagcggccggtggcgtaatccgcgatgtgtttatcaacgagattccgttgattttccgtaaagagatttatgccatggcatgcgttattggcggagtcatttattggggactcgaccgtctgggtgttgatgctgctttaacacaggtcatcagtggctgttgcatttttgtggtacgcgcattggctgtgaaatatcagatctgtttgcctatcctgaaaggggagtagacttatactaattttattccggcagtatcagatcaccggagaagctgatcgattcacgattctgcatatcgacatctatgctggacgaaccattggaatagatagtgattctaaacttgaactgatcttcggagtttctggcggtgaagtttatctttgctgctccgcgtttgcccatgaccatattatatttgtcaatcggagccttgaacatcagtccttgccctcctccatagggaatagaataagcacgcccgaaatagggtagttgtgaaaagaccgaatcgtttcgaactatcacagaataaactgaggtcagtggaatcatatgccctcggcgtgggtatgctgtagatacgtcaatccggtagttttccgattcgattagttcttttactgtttgttctttttgctctttcttttctttccggctttgggcctgaagcgggcaaactcctgttccgatgatgagcaacatcagaaggatgatacatttgcttgttttcatatcaatggttgtttttcggatgtttacataaagataacggtcggaaaagataaaatgtataaagcagacaaatgatttaatattatttcgtgtttaccggatgggatttcacaaagaataaaaaaggagggcatgtcaaaacttaccacagattgcacggattaacacagaatgaattttaaatcgtcgtttacataatgcttaatctgtgtaacctgtggcgaagaagacttttgagtctatatggggaggatatttctgttagaactgttccagaatggcaattcgtttttcgattggcggatgggtggcgaagagcccgcttagcccgctcaatgcgcttttagcctgtttgccaggatgttgtatgaataactgcgctacatcttcgcgctccacagcttctatatcgggatctgcagatatctttcttaaagcactggccagagctaatgggttctttgtcatttctgctgctcctgcatcggccatgtattcacgtttgcgggagatggcaaagcgcatcagcgtggcaaagaaatagccgatggcagctacaatcatggctaaaaccaagatgaggatggcaccattgtttttatcattccggctgcgtgtccacgaagagtaataaacggagcgcagtgctatttgtgccaacatcgaaaagatgcctacgaatacaatggagataatcagcagtcggacatcgtgattacggatatgtgtcagctcgtgtgcaatgaccccttcaagttcttcgtcattgagtttttcgatgattccttttgataaggtgaccgtataagtacgttcgttaattccgctggcatacgcattgagtgaattgtcatcgattatgttgattttaggcattttcatcccttgcgacatacagagattctccactaaattgtagatgcgtttattctctttacgttccaatggtcgtgcccctgtagcggctttgataatactggaattggcaaagtaggcaataataaaccagaccagaacgcctcctataatataaggaatcagattaataaacatttgattggtcattgccaatgtgtcgtattgcccgtaatcatctgtcacggtaaaagtgatgagtaggtagctgaacaaataagtcagtactgccaccaggcaagggaaaaggaacagtaagatgccggaacgtaggttattccggctctgttgtgtctgtattccgacgtattgcatgtgtatatactttcctggggattagaatttgattttcggggcttcttccagattggcacgttgttcagtacccaaatcgaacatcatttctttatgaaagccgaacatgttggctatcaagttggaagggaatgtctgtactgcattgttcagttctttggtagctgagttaaagtagcggcgtactgcagccagtttgttttctacgtccgaaatctcttcctgcaactggaggaagttttggttggcctttaaatcggggtaagcttccaaggtgattttcaatcccgcgagggcggaactaagttgattctctgctgtaatcttttcatcgattgttcgggcactgacagctccgttgcgagcctgaatgacgcgttcaagtgtgtccttttcgtgagctgcatatccttttactgtatctaccaattgtgggataaggtcgtgacgttgctttaactgtacatcgatgtcggcaaatgcattttcacggttgtttctcagttttaccagcgagttgtacatggaagcaatgataatggcgaggatgactacaatccccaaaatgataagtaagttcataattcttttgattcttaacgttgttaaacttgatccaaaggtatgtgattcagtctctatttacaaaaagcgcataataaaaaacattaattatcaaacaaacctctcaaagtgtattgaaactttcctgaaataacacccaaaaactgtcaaatagcacccaaaaactatcatttgatagtttttaccccaaagattggtgaaatttaccctactgaaatctaaaataagccttaaacttgcatcatcgagaaagaaacgaaatattaaccgcttaaaaaccgcaacgtatgaaaagtttaagttttagaaaagacctgataggggtacaagaagagttactccgttttgcttataaactcacagccaatcgcgaagaagccaatgacctgttacaagaaacttcattgaaagcattagataatgaagataaatttatgccggatactaattttaaaggctggatgtatacaatcatgcgcaacatctttattaataattaccgcaaagttgtgcgtgaccaaacttatgtagaccaaaccgacaacctcttccatctgaatctcccgcaagactccggatttgaaagtaccgaaggagcctatgacttgaaagaaatgcaccgtgtagtaaatgcgttgcctaaagaatataaagtaccgttttcaatgcatgtttccggatttaaatatcgtgaaatagctgaaaaattagaattgccactcggtacggttaagagccggatcttttttacccggcagagactgcaacaggaattgaaggacttcgtttaattaggtattatttatgaaataaaaagattgattttaggtagtgatttagtgtagatttttagttgtttaaaagaaggagtaagtgagggaccccctccttgctcctttatttttgtgacaatatgatatataacatgtcttttataagaactttttgggagtgtaatttgtctttatgtcaaatatctcagtatatttgtaatataacaagttaacctaatgaatgtgaaatcacttataacttacggcaatgaaaaaggaaattaaattcagtctcgtatatcgggacatgtggcagtcgtccggtaaataccaaccccgtgtagaccagttagtgcgaattgcccctttgattattgagatgggatgttttgctcgtgtggaaaccaatggcggagctttcgaacaggtcaatctgctctatggtgaaaatccgaacaaagcagtacgggctttcaccaaacccttcaatgatgccggaatacagacccatatgcttgatcgagggctgaatggtttacgaatgtatcctgttcctgccgatgttcgtcggttgatgtataaagtcaagcatgctcaaggggtagatataacccgtattttttgtggattaaatgaagtgaggaatattattccttccatacactatgcgcttgagggagggatgattccgcaagcaactttatgtatcaccttttcaccggttcatacggtggaatattatacggctattgctgataagctgattgaggccggtgctcccgaaatctgtctgaaggatatggcgggcgtcgggcgtccggccatgttaggacaattgactaaagccattaaggaacgccatcccgaagtgctgattcaatatcacggtcatagcggaccagggctgtcgatggcctccattcttgaagtttgtgagaatggcgccgacatcattgatgtagctatggaacccatgtcttggggaaaagttcatccggatgtgatttctgtacaggccatgctgaaagatgccggttttcgtgtacctgaaattaatataaaagcctatatgaaggcgcgtgccatgacacaggagttcattgatgatttccttggttactttatggatccgaccaacaaacatatgtcttccctattgttgaaatgtggcttgccaggaggaatgatggggtctatgatggccgatttgaagggtgtgcatgccggtatcaatatgatattaaagagtaataatcagcctgagctcagcattgacgatctgcttgtgatgttgttcgacgaagtggaatacgtatggcctaagttaggctatcctccactggtaactccattcagccagtatgtgaaaaatgtggcattaatgaatgtaatggcacgtgtgaaaggtgaggaacgctggagcatgatagacaataatacctgggggatgattttgggtaaaagcggccgtttacccggcccgttggatccggaaattgtagcattggccaaagagaaggggtacgaatttacagatgaagatccgcagaagaactatcccgaccagcttgatgaatatcgtaaagagatgcaggagaatggttgggagttcgggcccgatgatgaagaactgtttgaactggccatgcatgacaggcagtatcgtgattataaatcgggagtagccaagaagaggtttgaggaagacctgcaacgtgccaaggatgcggcattggccaaacaaggtttctccgaagaagatgtgaaaaggatgaagcgtgctaaggcagagccaatcactgcgatggaaaagggtaggattatctgggaaatagatgttgaatcgccttccatgcctcctgaagtggggcataaatatgaaccggatgatgtattttgctatattgctactccatggaacacttatgatagagtattggctaattttagtggacgtatcatcgaggtatgtgccaagcaaggtgctttggtcaataaaggtgatgctttggcttatgtagaaagatgtgaagaaccggcataacgttttaaaagttgtattgttatagagtggataaaggccgtttccggtgtaaaccggagcggtctttgttttttagtgccattccgaaacccagcctctcttcttcctgaagcccggctgtccggtgttcttatcccgacgcttcgatgtccggagcccggcactccgttagctgaatcccggctgtccggaaggtcggtcccggccgtccgatctttaggtgattcgtttcccgtcttatttgcttttctttttatttcgactactaccgtagttattatataaggcttgggttgtatatgacatttgtaatatcttgtttcggtagaaatctaccggctctttttcgtagatagtaaataaatattgggtttatattcagaaaaagataagaattagttttcgattttctaaatctggatggaacttttacttgtaaatagtgatcaaacttcgtatatatagttaatttgagaaatgacacatatctttcaaatccctttggaatggatatataaacggatcaactaagttctcttagaacttggttattcttgaaaaatgtaaattatatgcaatattaaatactttattacgctgtaattttacatttgtcaatcagatttagttgtatattttaaaataaggagttgccaatcttattttgcggagtaaagatagatataaagtatcaaaatacaataaatatactataatatttttaaatgctaatttctacttttttttcttcgccattcaccacctttcagaatccctttaaaagttactgtagcgttttttaagactgagttctaagagaactataactattattataacctaaattaacacatattgtttaactaaaaaagaaaaatgaatgaataactcgaaaattatcaatgtaaaattgatgaaaaaggtgttagtacttgttctatcttttttgtctgttactgcttttgcgcagaatataacagtgaaaggaattgtaaaagatggaaccggtgaacctattatcggagggagtgtacttgtcaaaggctcatcgatcggtacagtgactgacattgatggcaattacactttatctaatgttcctgcagacggagtcctggagttttcttacatcggcatgaagaaacaggatgtaaaagtaagcggtaaaactgttattaatgttgtgcttcaagaagatacccagatactggatgaagttgtggtgacggctttagggttgaagcgtgaacagaaagctttagggtatgcagtgaccgaggtcaaaggcgatgacctgaaagctgccaatacgatttctccggtagccgccttacaaggaaaagttgcaggtgtcgagattcgtcagtcagacggaggtatgttcggagcaacgaagattcagattcgcggtgcttctactttgaaaggaaacaatcagccgatttatgtgattgatggagttattcttgataactcgacttcaggaaataccacaatggactgggatgccggaaacaataatgccaatgactatggtaatgaactgaagaaccttaatccggatgactttgagacagtttcggtcctgaaaggtgctgctgcgactgccctttacggttcacgtggcctaaacggagctgtggtgattaccaccaaatcgggaaaaggcttcaaaggcttcggagtttctgtatcacaaacatttggtattgatcatgcttaccggacaccggatatccagactgaatatggggtggggttgatgcctggctggaaagacacggacaacaatggttctgtatgggatccttttcagttcaaactcgatgataaaggagaccggacactaataggcgcaggcagttatggatggggacctaaatacgatggtcagccgatccgcaactatgatggtacctggaccaattattcgccccataaaaacaacatgctggatttgtatcaattggggctgaactccaatacgaatgtggctattcgcggtggcaatgataaaacatcgtattacacttctctttcttataagaaagcaagatctaccagcgaaaagaatacattcgagcgttattcgtttttattgaaaggttcgcataaaatcagtgatcgggtggaagtttcggctgctatgagtttcaccaactcaaatccgaagaattctccgcgaacagtaggagagcgtttcgtcaatccgaacggaaccattatgactccgattctggatgtgaattatttccgggataaatatctgggtgagcatggtggactggcatctacaagttatggtgacaagtatggttcagttccgggacgtgatttgttttttatgatcgacaaatacgattattcccagaaagagactgtggttcgtccccaaatggaagtgaatgtgcagattctggattggctgagatttaaagccgatgccaatatgaattactattacactaagtttgaagaaaaacaactgggtagtggatatgcaaatgaaggcggtaagtatacaatggggcaaaccacaaaagagcaggctacctttggcggaacatttactgtcaataagcagatacaagatttcagcgtaggtggtttcgcgcgatatgaatactatacaagtcgttcggaagcatataaagtatatacagatggcggtatggtagtaccgggacaatggtttgtcgacaactcaaagaatcctaaaaagtcggaagcgagcatttcaaatactaagagaatgatgtctgctgtctttgccttgaatctgggatggaaaaatcaggtttatttagatgtaacagggcgtaatgactggtcgtcttctttggtatatcaaaacgggacgggcacatattcttacttctacccgtcagtatccggttcatggctgctcaatgaaacattcgatttgccgcattggattacatttgccaaagtacgcggatcgtgggcacaggtcggtaacgataccgatccctattatgtgaactcggtatatggctttgaaaccaaagaaatgtatgatggcaatatctatgtgaacactctcgataagacaatgaagagtttgaagctgaaaccggagcgtaagaatgcctgggaagttggtttggatttacgtttgtttgacagccgtttgaactttgactttacttattataaagaaaatacgagagaccagatcatgtcgattgaggttcctgctatttcgggtgtgaacactcagttgataaatgctggtaatattcagaataaaggtattgaaattgctgtaaacgccactccgtacaaaaataaagactggcagtgggatgtcgcaatgacatatacaaagaataaaaatactattatctcattacatgaaaatgtagcagactacatcgcattgagcggctatgctaatgattacgattaccatatcggttcggttgccaaagtaggtggcgactacggattattgatgtccgacattcttccggctaaaaatgaaaaaggagaaacattgttggagtgggacgatagttggcggggagcttacgaagcacgtagcggaaaagtacaggaagtgggtaaaatgactcccgactttttgggctctttatctactactctgtcctggaaaaatttgagtctgcatattgctactgacatgcgttttggaggattggtagcttcttactctaacttgtatggtacacaggccggatggatcaagagttctttaaaatggcgtgatcctgaacatggtggtttgtcttggaccagccagtatggtgacagtaaaggaatctcttatggtgatggtgttatccccgacggagtatttaagaatggtacgttcgcaacacttgtagacggaacgaaaatggatgtaagcggtatgtcctacaaacagttggtggcagaagggaaattggaacccacacatgccggaacttatcatgtaaaccgtgcggcctggggacagaatacgatattcgacacttgggtacacgagttgaactatattgctttgcgcgagatcaccttatcgtatcgcttcccgaaatcagtggcaagtaagtttggtgcccagggattgggattgagcttctctgcgcgtaatctgggatacctgtacaactcgttgcctaaccatctgaatcctgaaagtgttcgtggtaatacggcttctgagttccgtatccgtggctatgaaccttacacggctaattatatgatgactattaatgtagatttctaaacctttaatgtgatatttagtatgaaacaaatgatgaaaaaatatctatatatggcagctgtggctgttgtaggtacaggattcctgatgtcgtcttgtaaagacgaatttgccggacagaataccaatccctccacagtctcaaaaccgaacgtacgctatttatttactcaatgtgccatgagttttcaaccggccgattatcttcagtggtttgccggcttcgatgcaatgtctacctgggtgcaggcaactgcagcgggaggtggaaattccagcaagttgaatgtggtaactcagaccggctgtggctatcaggtcaacgaggtgcttcgttatacgaatgaaataaagcatcagatcagtctgatgtcggatgatgaaaaagcaaaatacgaatatattgcttatttatgtaatccgatgctggtgtacttgggacttgaagactcggatatgtatggatcccgtcaatattcagaggcagaaatggcccgttatggtgggactctgactccgaaatacgatacacaggaagagttgttcgaactctggctgaaacagcttgacgagacaattaactatctgaaggagaataatccgcaagacgtgcttggcgcgcaggattttatttatagaggaaaacttgataaatgggctaaattggcaaactcattgaaactcagaattgctgcacgcctggttaataaagacaaggctcgtgcgattgccatcgtgaatgaggctgcccagaatccggccggtcttattttaactctcgacgatgattttgttttcaataaaggtaaaagagacaataactggaacaatgatatttccgttggtgcgggaactaagcagttaatcgattttatggtgagcaatcgtgaccctcgtttgttttactttttccagaagaacgattacaactctaatgtagttcaaggtttctttgatcaaaaaagagctttaccgtcttatgtagaagccaatgtgaactatacggtcgatgcggacggaaagaaacactttgagagttggaaagctcccggagagccttgggtacgctattatggagttccttgtcaggtagatatcaataaaaaggaagagtacaaagactatttcgaccccaacaacgagttgttctatttgctgagcaaagacggtgcgaaaaagacctatactccgattgcctaccggaataccgaaaatattaaaggtctgttgatttacacattccccgatgttcccgatgtagctcccgtacaagataaggaagaatacggctggtacggactgtacttctctgcaggtgaaaccaacctcctgctggcggaattcaaattgttgggtgccaatctgccgatgaccgcacaacagtatttgagtgcaggtgtcgagatgtctgttcgtggttatgattttgtttcctccaagaatcatattccttattatgataaaacctacacaggcgatgtacacgataagacaatcagcctgaaagaaggcatgattgatgaaatgctgtcacatgatgcataccatctgacaggtgatttgagtaaagaccttgagaaagtttatattcagcaatatattcactatctgatgcttccgatggacatgtttgttaccgcccgtcgttcgggagtgccaatgaagaacagtaccttgttgccatatcaggattttgatccgttattgggtgaccagtacgtcattccgcgacgtttcccggtaagcaaacctcttgattctgatttgctccgtgacattacaattgcagcctatcaggcacagggctatacgtatgaaggtgagatgagtaattcacctgtgacgttaagcaaagaacgtgtctggtatgataaagaggcaccggcttttggtacaggtcctcaacagtaattttctgttttacataaatctccggggctgcttctgctttttgcagaagtggcctcttttctatattatccttatatcatcgggggcggtttggcgaagttgttatttcttctttttcttcttctgtttttttgtatctttttctttcgctttttccttatcaacaggagggaacttcggaaccagattcatcagtcgcagaatttgtccttggcgtcgtttgatataaggtgaggggtgtgccgagtcgaatcgtattggatttggtaaagttgctgcgatcagggcacactgtccccgggtcagtttggcggctgtcgttttaaatttatatttagcggttgcctgagcaccgtaaatacctttgcccatctcgatggagtttagatatacttccataatccgttctttcgaccagcaggtttcaatcagaaatgtaaagtagacctcaaacccttttcgtacccacgaagactgtggccaaaggaagacgtttttcgctgtctgctggctgatggtactggccccccgtttctttttccgggtttcgttttctttcatcgcttttttaatttctatcatgtcgaatccgttgtgagaggcaaagcggttatcctccgaagcaatcaccgccatgggcaggctgggagagattttatcaaatggtacccacgtatgcttgcatatcactttttctcccgaaacgagttgctggacagagcggataatcataagtggagtgacatataccggcacgaatcgatagaaaatgacggcaccgatcgaggagataaagaaaaaaaggatcagattgcgcagaatgcgaaagggtttccggagtttcattgtgtgtgatcttgttggtttgttatacgaatgtgccaatatactgacttaccatccttttttatataagaggagcaaacagtatattggcacatggcataaaacacctgtgggtgtattatgaaatcgttatttaccggcttcagcgtttttaatcatctgttcactggcgtacataaatatttctacacgacggttttgttccggtgtttctgactcgttgtattgtgagtagcctactccttccacctttttgaattggtaaggtttaacgccacatgcctgaagatagttttcaacggcgtatgcacggttggccgatactttctggttagcttcgtagctgcctactttatcggtatgaccgataatggctacatcgactgtcggatcttctttcaggatattggcaaattcagctaatgattgtttagatgctgcacttagtgcagaagagttgaatgcaaaaagtatacctgaggggaaagttacctttacggcagccagaccattgttatcagtaacttgttctacttgtgcgtctttgatctttgcagcctcagcagctttcttgtccatcttacgaccaatgagaacacctgctccggcacctacggcagtacctactgcagcaccgatagcagcaccttttcctttaccggcaataccaccgataatagctcccagggccgctcccgaaccaccgccgatgacaccacccttagctgtattattcatgcttccacaacttccgaaaacaagcgccatgcttagaaacaaagccataaatttaattttcttcataattaagctctttttatatagttaataattaaatggatacttccattttataaaaacgtggcaaatatacagattatttgttttgcctgtcatttaccttgtaaaaaaaaacaagaagatatgtgcttttgttgtctaagctgtgctttttcttttcagagtatcgggcgcgacaacactttccgtttaatcaatgcaaaccaaccggccagaataacccctttggcaacagtagtgacacaaacagcccaccagataccttctactcccatgcccatgcggacaaacagaatggcgagcggaatacgcatgtagttgcaggtgatgctgataacggcaggtggaatggtgcgtccgataccgtagaatacaccttgtgtcgtgatctcaagcatcataaagagttgtgaataaccgtcgatgcggagaaacacgcctcctgcttcataagccgcctgttcgggaacaaagagagcaaagatttcgtttccgaaaaatacaaaaagcagggtgcagagcgtaccgaagattgaggtcattaacaaagtcgtatgccatgattttattacacggtctgttcgtccggctgcatagttttgagcaatgaatgcgcttaaggcagtggagaatccttgtgatgtattccaggtgatagcctcaatttgtcctccggtggtaaaggtcatcaatccgatatgccctccttgttcggatgctgtacggcaaaggaacatattgacgaaagcaaacaaggtgttaagggtagctaccggtaaacctaatttaaggatacgatgggtatattttttctttaaccgggtaaagaaagagaatcgtcccaataaagcgtctctgcaacgtaattgatagataaaaatgccgaatactgctgcttgcgaaatccaggtggcataggctgctccgttggtacccagcccgaaaccgaagatgaagaggggatcgaggaggatgttcaataccaatccggtaccactgatgtagaatggtatcttacttcttccggcggcattataaatacctgtaaaggctgccgaaagaaaaatgaaaggtagcccggtagagataatgcgcagataagcgattgcattttcggtgatgtgcgcttccagttcgtagataccgatgatgggacgtgcaagcaggaaaagcagcccgccccagcaaagtgaaataataagggcgatagtaatgttgtgtgacgcgaaattacgggcatcttcatgattttgtgctccgatggactgacctacactgacctcggaacctactttgttcagtaaggaaatggaaccggacatccaggtcaggatacctaccgaaccgacagcggcgacggcttcactccccaaacgccctacccaagccatatctgtcaggctatatgccatttggataaacgaggtagccataatgggcatcgccaagttaaacaattgtttattgataggaccttgagtcagattcttgattccttgcatgatactatttaataagaaatgagtggcaaagatacgactttcttccggctgcaatccttatctttgcagagaaaatttatagaagaatatgaaaacaactcagaaaacggtcggatggtatcatgtgatggcagcggtgacagtaatgatatggggaacgactttcgttgctactaaagttttaataaaatatggcctgtcacctgtcgatattttattctaccgttttttattggcatatatctgtatctggtttttctctccccgtgtgttacgggccaaaagttggcaggacgaactgcggtttgtggggcttggattgtgtggaggctcactctattttgttgccgaaaacactgcgttggggatgacgcttgcttcaaatgtatcactcattatctgtacaactcctgtcttaacagcgctgctggctcctttcttttataaaggtgacaaattgaaggcccgtttggtaggtggctctttgatagcactcattggagtgggactggttgtgttcaatggcagtttcattctgcagcttagtccggttggcgatattctgactctggcggcagcattgatgtgggctttctattgtttacttctcaggcggatgaatactcattatccaacgttgttcataacacggaaggttttcttttatggtctgctgacccttttacctctcttttttgtctctcctttgcagatggatacacatattcttttccaaccggtcgttgttttaaacctgctttttctgggagtgattgcttcgatgctgtgctacattatgtggaatacggcagtgaaacaattgggagtggtttgcactaccagttatatttacgttgttccgcttattaccttactgacttctgctatcgtgattgacgagacaatcacgatagttgctctattgggatcggcattgattttgagtggagtctatattgccgaacgaggagtaggcaagaaaaagtagatctgtatggtcttcagttttcggtctcttctatttttgaagaaattttctcgatggcttcacttaactttttttcgggaggaattatattgaaatcctcccaaaaatctttgtcgtatacaaatggagtttctgcaaaaatggtatgtgtagccagtcggtcactgtaagcgaaacggctgacattgcccgtttctatcttacaagtgaccatttcaaaccaagtatgcaggtttgtattgctgagccatttgttcctttgttttatcttgaagtgtaagtctccacggacatggtggatgtaatacgtttgattccagggcttataagataccgtatagactaccttttgtggaataatccggatattgcggcttcttttttctaccagcatgttggcggctttgtgtatataccggggaatcaattcgaatcgtgcgcgtagcagggcaccatcttcagtatcgatatagagttctccacaatagtatggggtcttgatgcccggatgttgtttgaagtagatcacgttggcaagccggttatcgattacggcaagatcgctggaagtataaacgtatacacactctttggagtccggaagtaggaaattgggcagactcttgataagatccaattcgatacaggcgtggatacccgatttcattttagcaattaaagtgtcttttacggcttggttggtgatgcgtcgcattttcagtaacttcacctgatcagccttctccggatcgtccgaaggagctttgtatatcttgaaaattccctctgtcagactgacaaaccgattcttttgttcgattccttctctgtaaaaagaagtcaggtagacaggattttgtgagtaattcttttttcgcaatttgagcatttctctcaacaggcgtaccgggttgacaatacgtacgataacctcctgcaaaggaattactttgggttctaatgcaaaagtaccgcttcgtccggcaaggagggaagcgtccgtcgtttgtggcacatagcccagatgtgaaaagtgaatccgcctgttttggagagagtcgggcagattaagtctgaaacttccattttgattgctaacgctgccgatagaggttccctgcacacttacggtagcatagggaatcggttctctggaaagttggtctattaatattccctcaagggtgaaaaagaatgtgttgtctttgtgcgagcttgcttcccgttcagttgttgctatggtttccggttggttgataataatgtgcttatccacagagcggagttgaagactgtcgctgccgatgatgtcataaatggcctgacgtacggttcgttttccgccttttaattttatcttacgctcattgtcaatcagtttgctgtcatagataaacagatatcctgtctcttctgttattttggccaaagattgatagactgttgcttcagttcttggaagccggatgatgcggtcgaagataccggagccgtctgctttcacccgaactgccataaacaatagcagacaagtgaataaatattgcagggagagacttttcaaagttttcatttctttttcttctttaagttccggagctacttagtaagagtgattacattatgcttacgtgtacacttcaggttcagtgccatgctaattaattcggccattttttcaggggagtcatccgaaaaagaaactgtcagcaaatgttcgtccaattccggggaactctctaaatggatttctgactggcgtagattaatggcatgcaggatattgtccagccgttcgtctttaaagcacatcttttgcatataacgggcaaactgtttggaatctttggttgcagtcaggtgccatttattctgtaataaagtggcagtttctcctgctttgacgtgtatttcttgtccgttctgtttttgagtgacttttacttcgcctcgctggacggataactcaaatggagaattaccactgttttttacatggaaggctgtacctatcacctcaatctgtacttttccggtttcaatgaagaaaggacgtgcacgattgcccgctacatcaaaaagggcattcccttttaggcttacctctcttcttttttcagaaaagtgtttaggatattgcaatgaggtttgtccggaaagatagactacagaaccatcttcaagagtggtgaccagtatgttctcttctttattggccttgaccagtaactcaccggtagatgattggctgtcggttcgtaatgttatgggcagatagatacataggaatatgattgctgcaatcgatattgtgctgatccatacaaccggacgtatggcggagctgtgcccctcggcaggtagcagcccatctgtctccaggcgattatataacttgttccacgcccggtctgttttgatcttgtttttttctattcgattcatgatgtctgaatatagttctcaatttcttttcgtaatgtttggagtgcccgggtcatttctttctccacagtcttcaccgatagtgagaggagggaagctatctcagagtacttctttccttctgtatggtgcagacgaaagatctggaaacggcgctccggtaattttttaagggttttgtctatcagctgttgcagttctttgtattcaatctgttcctgtggatcggctgaagccacattttccggaatagatagaaccgcatcctgatagcgttttctgacgtcttggtgttcgcagtactggatggaacggttgcgtacagaccgatagagataactcttgatagaatgaaagatttcaagtttttcacggtctttccagagtacatagaacaattcttcaacaatttcttctgctacgtctgtttctctcgttatgctggcggcgtacaggcaaagcggagtataatattggcggaataatgtttcaaacgcctttatatttccttcttttatttgagtgagtacgaatacgtcgttcagcatatcgggggtattgggagttagaattcgtcaaagatactaaaaaagtggttactgtttctgttgctttttcagtttgtttaccgcatgttccaatgattcggtgggttctatgatgttataagttccccagaagttgtcattggtaaagttatccactttgtcggaaaatacatggttttgtttgaaagcgactttatagggaatggctgttatgttgttttcttccctgtctgtcactaccatttccgataagatcgtgtaattggtagaaaagagtttgcgtttccagtcacatttgaaacgaatgttgttccggatataactcagataagtaacgtctccctgattcttgtacgataccaggtaggatacttctaccggcttgaaatgcagtccgaaaggttttttcctcagaatagcttgagtcgccttgtttttgtcatccatactgagattgaactctgcccgcgtgaacgaaaggcgttccttgtcaatatagagtgtaccatagcacagaggataagacaactttactttagggcggaaactgatgacatactgtgaccggtcaccgatgctggtcgggtcttccatacgaaattcgtagaacaataaatcttctttagccaacaggcaatcagggttctttactacatcaatataaatggccatattgggacctccaagtaattttacagccagtgtatcgctttgcttttggcttagcagtctgcgccctttggaaatctgaacccggtctcgttcggctgtttcattgtagggtgttttataaatgtctattacggcttccgatatattgatataccgtcgtcctttttgggcaatttccctgtagaatcccttgagcatattgcttttcggactgtagttggttggaatcttgcgaagtgcttcttccacaatgcttcgtggatctctggcccgtaccagaatctcgctgagtaagttggcataaggagagagccaaatggtctgttccgtgaggctttctcctttcagggggattcgggcattgagataaccgatatgcgaaacttctatgtctttagcttgaatcgattcgggaatttttaaagagaattctccgtcagtattggtgatggtaccgatattactttccgatatcgagacattgacatgctccaacttctttttattcgatttatccttgattacaccactgactatcgtatatttttccacattgtcctgtgctgtcagtggaataacacctgacagaatcaaaactgccagtacacatccgattgattttatccattgcgttttcatctttttcagagtttgaaaggtgaataatagtttgcttcctatatataagatcgttcaaacagagaataccctacgagtttctggagaaaaatgaaaaaaacttcaatgaagagtgtttttcagggataatctaatcgttttacttcaaaatctcgttcaaatctttagtgagacatccccatttgaattcatggttaggtgtcagataagggtacttggcataagaattgcgggtgacaactttaaatcttactatttgctctcctctgatccaaccataaaagccaacttcttttctgttgaagtctacccaccctacaacgacgtaatcttttgtttcggggtgctgttcctgtggataaccataggtccagttgtcggatggaggattggcggttgttttctttgccactttgatatctattttggcaccgtttacttttacgtcaaattcatcggtatgatgggattggaagtctgtatgatccaattcgaatggaattcccagattacttaaatgttgttggaatgctaactctccgatgcagcctaacagagctttatccaatctctctttatcggataacctgaaacgtgaataaagtccgttttctatcattttttcagctttggcttttgccaatgcaaccgtttgatcaaaatttaaattttgtacaatcatagtaataaggtgttttgtattttatatccggttattgaatgaaagcaaagatagtttttttatatcgtaatagtggtatgaaagctaagtattcactacatttgcgcagattatgattgccgatagattatgaaaagaggaaaactattgatacttcccttattgggaacccttatactgacaagtcttttttcctgtggtgtagaccgctggccggaatattatccggagacgggacgtgacatttggatagatagtgtgatgcgtcaggagtatttatggtataaagacatgccttcacctgccgctccggattattttcaggagccggcagaatttctaaaaaaggctgttgcttccatggataagggcttcagtaatattgactctctgcttgacgagcctatcccaagctatggcttcgactatagcttatacaaagtgcttgataacgatacggcttataatgctctgatttcttatgttgttccagggtcaccggccgaagaggccggattgaagcgtgggcattggattatgatgctggatggagattatatcaccaaaaaggtagagccggaattgcaacaaggaggtgtccggacgcttcaaataggtgtatataaagagatagttggggaagatggcaaaacaactggtagtgtcgtaccgataggggacacaacgatatctgcttcacgttctttgaccgataagcctgtccattatttcgatattatcccttgggatggaaaaacggttgggtacctgatgtacaatgagtttaaagcgggatcaacagcggatagtcagacctataatgacgatttacggaaagttttccggaaattccagacagatggtgtaaatgagtttgtgttagatctccgatataacaccggtggcagtttagattgtgtacagctgctctgcactatgcttgcaccggctgataaaatgaatcaattgcttgctttattgaggtataatgataaacgtgtagaatcgaatcaggatctgacgttcaatccggaacttatccagtcgggtgcaaatctcaacttatctactgtttatgtattgactaccaatgctacgagaggagctgcggagatggttatcaattgccttaacccttatatgaaggtgatattgataggaactcaaactgcgggagaatatgttgctacagagccttttgttcatcctacggatcggttcatcctgaatttagctgtatgtaatgtattcaacgtacaagaaaaatcggattatgtcaacggtttcaaacctgcatatgaatataacgaggattcttatttaagcacttatctgccttttggtaatacgaatgagacattgctgagtgtagcattgaaaacaatgagtggtgtaacggaaaacggaggaggagaaggaacaacacgtatggttgtaacgaagagacttatgaaattccatcctcgccgcggattgactttgggaatatcggaaaagtaatctgtcattttgtattttagaaatgcggagagacgtttctttacggactgacgatgacaaatagaataaaaacgcgtggattttgcaatagcataattcatgcgttttgtattttggaaatattgtgcccacgatgaagggcaattgacgaatattgtaattaaattgaatgctgaaatagcggaatggttccaaaatgctattctccagatgttcatctatagttgaattctggaagaaaattgcctttttttggttcggtttatcatttttctcacgacttgatcttgttttgctttctgaaattaatatcctgaaaacagaaagttaactttctgttttcaggatattaattttctcttgataagaagttcgttctttgtttttacgatgttaacttcctgttaacgacttccggctttcatcctataaatatgcggaatatttgcatcttacttgccgattcattcctgtttcgctgttttttgaaaaatgaatagttagtcaaaatggactttctacgattttctgatcaggatctcaggatattgcttgtataatgtcaatcgtcaagtgtagatacagatatatactttgcagctatttcacatagttaatcagccattttaccatttccggatcataatgtgagaagaatagacttttttcattgtcaagtgcggctataaccgtcatttctctttctgtcaaactgaagtcaaagacattgaaattctcaatcatacgttctttatgtgtagacttgggtattactattatgccacgctgaattaagaaacgtagagcaacttgtgcaaccgactttccatatttgacaccaatggcggccaaagtcccgttggtgaaaaaatcatttcgaccttcggcaaacggtccccaagccattagttctgtgccgtattcctgcatgacttcccgtagttttctttgttgattgaatacatgggtttccatttgattcaccgctggctttatctcgcagaattctgccagatcgacaaagcggtcgggatagaaattgctgactccgatagctcgcactttacctgttttgtttgcttcctccatggcgcgataagtgccataataatcattgaaaggttggtgaatcaaaagcaaatcgatatagtcggtttgcaatttttgcagggattcctcaatagatgcctttgctttttcgtagcctgcattcgatatccaaactttcgtagtgataaatagatctttgcggggaatgcttgattttcggatggcatttcccacgccttcttcgtttccataggcttgggctgtatcgatcagccgataccctacactgatagcatctgatacgcatctttcacactcttcgggagttacttgatatactccgtaccctaaaatcggcatttcaatgccattgttcagttttacatattccataatcatatattattagattacacatttaccggcattagactgatcattcagttgttttttgcctttttgattcaaatgcaaaaatagtcggttttgttcgttgatataggatatggattacagcttttattacctttattacggattaaaaagtattattgcattatgtttaccagatggtttgaaaacacttataagataaacttgttccaactgttgtcataataaaaattgtggttatctttgcgttctactaaaaaagtttggatgtttaaacttaagaaggattccgtgaagtaaataaccttttaaacgtaagtttgaggttatgctgcaattctggctcaggcatattttttgtctgagatattttcatatatatacattaataaattaaagcatcatgaataacgataataaatcaattcacgaattcgatttcgatttaatctgcgaatatttctcaagtataaaacgacaggggcctggcagtcctgaagtgaccattaaagctcttagttttattgaggatctgaacgaaaattctcgtatagctgatcttggttgtggtacaggcactcagacaatgacattagccgggcatacatccggacaaatcataggtttagatttgtttcctgcttttatagacattttcaactaccatgccagtcagttgagcttacaagatcgggtaaagggaattgtaggttcaatggacaatcttccattcagtagagaagagttggacttgatctggtccgaaggagcaatttataatataggttttcagcatgggctgaaagagtggtggcaatatttgaaaatagggggctatatcgctgtctcagaagtttcctggtttactgataaacggcctgccgagattaatgacttctggatggatgcttatcctgagatagatactattcccaataaggttgcccaaatgcaaagggccgggtatatccctgttgcctgttttattttacctgaaaactgttggatagaacatttttatactccacaagtagaagcccaggagaattttctgaaaaaatatgccggtaataaagctgctgtggattttattgccaaccagcgtcatgagacccaactctactataagtataaggaatattatgggtatgtgttctacataggaaagaaaatctgatgttcctgtcaaaaagttaaagaggctctaaaggttattattatggtattgataaatacctttaaaaggattgggaaaatgaatttcatctttcccaatcctttcttttaagtagtgtcgtaaggattgataggtgttttttcagactgtttgtaaatataggtaggcgataagaagggtttatttttcgcgggcaatctcgacagcttgtttgatgcggtcggccataccgattcctcctttgagatttcctgccaataccaatccgggatattgcttttgtagttcgttaattgtggtaaacctgtcggcgctgctgctttcgtattggggaatggctttttcatgccggaagatgcgtatcagatcgggtattattccaacaggataattcagcatctcgtgcatggtagtgccaattaacgtggtaatttcgtcattgctttttgtcaggagttcgggatgccttgttccgcccaggaaatatgaatacaaggcgccatcctttggagaacggttgctgaagcaagccgatggaaacagaatacctaaaacagatttttgttcacaggaaggaaccaatcccccaaaggcagggaactcttttccataagtattacgcagacccacacagacttgcataacgggagcataggtaagattgctaatccggttcatttgttcggtggggataaaaggaagaagtggaggcagggcataggcaggtatggtggttatcaccttccggcaacgaatttgatcgacctttccgttgacatctgtaaaaccaaccaaccaaccacgctcacaaggtatcagggacgttgaagtagctcctaatgagaatcgtttgttcccaatggcctgttccaatgcccctgtcagattactaagacctccatgggtagagaaaatttttcgtgtagccagtcgatcgcgttggtttcggggtgaaaacgattttgcaatgccaccgcggatgaagctgccataggtctgttcaagctgataaagttttggcagggcgtgacgggtgaccaaccgcatggggtcaccggcatatacacccgaaatgaatgggtctaccgcataatgcagataggacgtgcccaagcgacgttggaccagttcgccaatggtttcgtcaggattgtttcctcttgagcggaaaggttcgcataggatatttaatttatcttttgtactgaacaacggtgtggtaattgcattgaacagtcccgaggggagagggtgaaaacgattacctttccatataagacgttgtttggaagcttcgcgggctgtttctaaacggcagattggagagagtgcctcgagaagttcggctacttcagggtgagagattataccggtattcggtccgctttcgaaggtgaagccactttcgtggtaggtacatatctgaccgcccgtgcgggattgttgttcgattacttcgacatcacatcccttgcgagtgaggtaataggcgatagtcagtccggtgagacctgcaccaatgataatcgtgtctcgcaaacgataattttttgtttctggttggttcatttttacaaaggttttgaatatgagtgtggggtatggagcataagcttgtcaagtgaagcggctacgttgcgtacaaatgccgaaccttcggttgtcatctcaagatagtcatcagtatagtaaatcagcccgtcattggcaaagaccgacagtttctgttcatcataggctgtagcggcttttagagtcggtactgatacgtgcaaacggtttgacagagctttccaatcgatgcatccattgcacattaaggtttcaatcacttctctggttaattgctcggttggagaaagggcgtagcctttggtaatacatagttcgcctttgccgatagtctcgatgtagtggagaatatctttcgtgttttgagcataggccgattcgagttggctgatagcagttacgcccaagccatatacctgtgcagtagtgcgtcgggtacaataaccctgaaagttgcggtgtaattttttggtttgcatggcgatactcagttcatcgtttgggcgtacaaagtgatccattccgatagattgataaccggattcaagcaatagcttggcagcagtgtcaaacatattccgtttttcacgattatcgggtagacctgatttctccagaatcaactgtcgtttattgatccaaggcacgtgggcgtaactgaatgtgaccagtctgtcgggtgataaggaaatggcttgctctatgctacgagcaaagctttctactgtttgcttgggcaagccataaagaaagtcaaggttgatgcttacccccctttcatgtagcagagcaaagatatcttccatcgctactaaggaagggcggcgattcactgttttcaggacttcgatgttaaagtcttgcacgccaatactgacacggttgaaaccacattcggttaactgtagccaatctttctcagaaagatatccgggatggcattcaatggctatttccggacgatcgatcatccggaatgatgataataggtgagcattcagctctttgatcaaggctataggaatggctgtggggcttccgcctccataatgtatttgtgcgatcgggcggctcttgtccaacaaaggaagaatttgatccatctcctgatgcaaggcctttacataggattcaatgacttcgggacgtgccataggatatgagttgcatccgcaatagtgacacaagtgtcgacagaacgggatatgcagataaaacgataacgcacgttctgaaaccttgttcgattgctgcacagcctccaggtagcggctgttggtaaacggttcaaaataattggccggtggataactggtgtatcggggtaccggtacattgtatttattgattatttcagtatacatatgtgttaagaatgaatagtttgagattcttttctgaagaaacaaaagatatagatcagcgatatggaagccaatacgacttcgaagataaatagaccgtgataaccaaccctgtcggccaccactccgctaagaaaggccataagcagaccacttaggtgtgtgagtacagtttgaatggtaaaatcagttccttcgcatcctttgcgtacacaatccatggcagtggtatataccacaatggttgccataccgtaggcactccacaatagtacgatgcccaaacagagcattgggagtgagggaggcgtccacgaaatacacataaaatagagtgtggtaaacagaatgaatatcgcgaatagtattctggaataatatcgtccgattttgcgaaccagtaatccggccagaaaagatgatgcgaaagcggctccggtacctacgatgcctatcataatgcctatctctttcatcgaatagtccagatcaaccaggtaagaacgcagtaccgataaaatgccgataatgctggcgtagtaaagtagtaggaatcctatttgtttccagatactgcggcgggcaaagaaccatataaaatcggtaagtcgtgctcgctttgcagattccttgacagtcattttcatgcgcttattcttcagtaacgggataactgccaatagtacgaaaatgcataagcacggtatcactgcatgccagccatagtgttggagaacaagaagcagcacgcccgttcctattaatgtacctccgaagctacccattgattgcatactgttgaccaaacttttatcccgcttgtcaaaagaaagtacagcaagtgtgtctgtggctatatcttgtgtagctgaagctacaagtgatagaaacaccaatccgataatgaggtaaaggtctgtctggatgtcgagtagccctaataaaaggatcagtaaagcatatactatttcggatgaaatgatacagcgtttatagtctttcatggtgatgcaatgccggtcgatgagtggtgcccaaagaaacttcaatatccatggaagtttgataagctgtaataaggcgatggacgaaagagagtaatcagcctgtctcatcaatacttgtatggcagtagagaagaaactcatcgggatggcctgtgcgatatatagacagaaaaacgtaccaaggttcagtgtcttccgggatagtgggaaaaatctgtttatttccattttttgatgttgcttgattaaagacggacgctgacagatgtccccagggtgatgggttttcctttttgcgcataggctttgcttgtcacgaagtagtagctcagatagtcggtattggtgaggtttttgctccagacttcccacgtaaagtttcctttactcgcaccaattttcagattgaccagtgcatacaggttttgtttggcttggttgtcttcgtaccaatagattgggcctgttgccgatacgccaccattgagtgtaaggcggtcgatccaggagcagatgttgtagaatgtatatccggctgttaaagagaaggtgtgacaggggaccataggcaggtaattacccccataatcttttagggtgccacgttcttctttcttatagtgaacaaatcgggcatctgtatatccataattcatatgtacgaccaatgaatttaccggacgagtctgcaaacttatttcgacgcctttattgcgagagcgaccggcgtttcggattatattacctacagccggaatagtattggttatctgctggttgcgccaatctatatagaacaatcctaagtcggttgtcagtcgaccattcaggaaagatagcttggcgcctatttcgtagttccagttatattcgggtgaatagatatactcgtcatcgttgaggaaagaaacattaaatcctccggttttatatcctctggatacggaagcgtaaagcaattgattgtgggatgagagatattgcaagctgaacttgggagtaaactggctgaagtgaagggatctgtcgaattgtccgagagattttgtttctcccttaccatccaacggctgttgcactttggaaaaatcgcatcgggcctgttcataatcgtaacgtaaacccacagagcaggacaaaccttggaacagatcgagtgtggattgatgataaaaagcaatcccttgagtggggatctcactattagtaagatgccgggtggtatctgtaaaacgactgaggtcaactttcctatctaccgtttgccggaaagcaaaaagccccgttatccagtgataacgactgttattgacagattttgctgtaaactcctggcaatacatatgctgtcgtatccggttttgcccgtagaatatattgcggggcgagaaatcttgatcaatccccattttatcttgtatatactgataggaggtttggctgttgaaactaatgcgggaaccattgtagcgtacattaatcccggaagtcaacagatttcgtcggtacagtccttcatcattgtagtttacggcttctgttgttccgttatcggcattgtacaatccgtatggatatcctccctgattcgaatactcgtaggaagttatgaaacgggtggtccaatgggctgcaggtttccatatcagtccgattcgtcctgctccattatcaagcttgtccgctttcttatgggtatacaggtttgtaaaaaagccatcattgtggtggtaattgccgctaatggataagcccagttgttcgtttacctttgtatggtttgaagccatcaatcgaatatcattgtaactgccatatcctaaccgaaaacgtgtaccttgataatcaaggggtgaatgggtgtatatattgataattccaccgatagagttacgtccgtagagagtgccttgtgggccgcgaagcacctctatactacttatgtccgacaagtcaacatcgaaagctgaggtttcaaaatggggaattccatcgacataaaaccccaccgatggagcatctttttttgctcctatgcctcggatataaaccggagagttttgtttagatccataatcgggcatatagaaattaggcagtaaggagcttaagtctttagctcccgatatttcattttctttaaggaagcgattatctaaggtagaaatagaaagtggttcacgattgggattgttctgtttaaaacctactatcgttacttcatccagactgataggcttaaccaataccgtatcgggttcattagctgaaaccattgtggaaaagggtaggaggaaaaatagttttcttatcatatttttagaatttgcggcaaaggtagaccatgtttccagagcgggcaatcctcatttcttaggattttatctaccagtttcagtttgccttgcattaatcgtttttatcttttattctgacattattggtcgtgtgcctttttcatgttttcttttggtatataacaaaccacccaattctatcagaatagtataaatagggggtattgcttcatttgactgatttctgttagcgacgacagctcctttatattttccctaaaagggctttatgatataacttccggggatggaaatcatatgttgttttcgtcggtttataggaagtaatagtttgcttatagattgtatttatttgttgtatagagatttatgttacttctgttttcctcggggtgcattgcggttatttaatagttagccaattatagtgccggtattctgaaattgtctgatacatataaatagtgttcttttttatataaatataagagtttataagatattacttttgcatcagaaagtacgtacttattaaacgcggttctgataatatgactttttatccccatatctgtattgtcaactgtcgtttatataattattttatacattttattgataaacaaaatgaacaatgctaaattattacatttaatggtttatatcttaaccattattttaggatgggcttgcacagaagtggatattacgatgcccaaaggtcctaaaggtgatagaggaatgtcggcttacgaattctggaaagagaatgtagagaatggagtgatatcctggcctaaacaagagactgagataactgatttttttaagtacttaaaaggtaaagacggtctggatggaaaaaatgcttttgaactttggagagaggatgtagctacaggtactttagataatcctcaccgtccgggaagtaaatggcccgtatctcaaaataatcttagagatttttggtattatctgacaggagcgagtggtgagaatggccagacacctcatatcggagataatatgaattggtggattggtaataaggacactggaatacgcgcacagggcagggacggacgaaatggtgaagatgctgttccaccgattgttaccattggggataatggtaactggctgattgatggggtagatacaggaagaccctccagaggtgaagagggagttgcgggaacaacacctactattacaattggagaaaatggaaactgggtaatcaatgggaaagataccggaaaggctgcgataggtaaagatggaagatctccagaggtaatgatcggtactaatggaaactggtatattaatgggaaagataccggtattcgtgcatatggtaaagatggtgttgacggcaaagacggtactaatggaaaggacggtactaatggaaaagatggtgctgatggaaaagatggtgccgatggaaaagatggtgctgatggaaaagatggtgccgatggaaaggatggtgctaacggaaagagcgcttatgaattgtgggtagagagtgttgaggccggttgtaataatactgggcctaaagtgaaagatcctcataatccgtctttggattgggattgtggtaaaacctctttgagtgatttttgggagtttttgagaggtgcggatggcaaagatggtgcggacggtaaggatggaaaacccggtattccaggcaaaccgggtgctgaagttactattattaaaggagtacctaacgtaattgcgctttattcgcagcaagaatttggcgagtatgtccgtacaaccgatggaggagtagcttatcgtgtgtatgatgaatctggtaataaggccccaaaggctgtagttaagggaatccccggcttggatccgactaaaacctacacagccaatgaggagggggagtttattattccgaaagaagatcttcctcagattgatgaggtggatgctcgatggggaaaagttaaggaggtaactattaataatgtgacaaaggaatctgcagaaaacacttatgtccctaacagaatgcagattagaatgatttatattgccacctctccatatcttgattttgaacataacctgcagtttagagtagaaagaaagacagatcctggtgcagaatggaaaactcttcccagctatttacctaatgtaaatgccgggtttacggcataccaggttacaaatccggaagatccgacatctcttgataaaacgaaaaaaatagaaagtactacacctaatatgagcagtacatcaatgtctattaatcctaatagatatgttaaagagaaccttgctggtataaaaaatggaataactgacttttgggatggaaaagataactatttctcaatagtaaaagataccccttattatggagaaacgctttattggaatggagtctgtaaaatggcaccttaccagatacctcctacacttaaaacattagttttgactaaggcatctgctgaaagtggagataatgtattcttaaatcgagctcagggggagtttgacttttcgactattgatttcaatatcatatctaagcgtgaattggtaaaaacagtgaaaccgaacggaatagattacattgaaccagtattttatactccggaagaggcgaagggacttttactttgttatgttaagtttacatatacctctccattgggagtgcaaacagctacaagcgaacataataagtcgagttataagaaacctgagtatgctgcccttagtccatatttgggagctacaatctattcagtgggagcgaacagtgctttcatctactctaactctagcagtggtgtatctttaggagttctcaagaagaaagtagatgatggtacatattatgttgaaaatacatataaaaatatgcctgaaattaatgtaacttataaagacaaataaaatataaacaagatgaatttcagtgtaataataaatagactttttataggagcattggcttttactgtctttcccttctatacttatgctcaaaacgataaagtggagagacaaacagaatatagaaccaaagcttgggaggtgggggctggtggggctcttatcaactgggatagagtgaccttctccgatttccgccaaatagatggtgattatttgtatcggatgaatatcgatcatctttttggtggtatccaactgtatgctgctcgtgaactgaacccctggttttacattgatttgcagggaacattgggtttagcaagaaatcaagttgaaacaggcgggcgtaaatacgatttcatgtatatggccggtccgggacttcaatttcgatttactccattgtttaaatcaaaatatgtagaaccttatttacgtataggtgttaactaccttcatcatgattttcatgcaattaatgcgggtaagtttgggaatgatcctataggagaagcagaatggacgtcatcaaatccttggaataaagagacaataggatctaaacaatcctatttccccttatcctttggagccggggtacaagcttggtttaacgatcattggggaataggattacagggagaatacataatgcctgtcgataaaaatcaaacgcgttttgttcaggcttcgatgcgtgttatgttccgttggggtggaagtacaaaacgtcccataccggttgtacagtacatagatcgtccggttgataggattgtagaacggattg
